(12) United States Patent
Bayer et al.

(10) Patent No.: US 11,421,207 B2
(45) Date of Patent: *Aug. 23, 2022

(54) METHOD FOR PRODUCING TREHALOSE EMPLOYING A TREHALOSE PHOSPHORYLASE VARIANT

(71) Applicants: C-Lecta GmbH, Leipzig (DE); New Matterhorn, LLC, Wilmington, DE (US)

(72) Inventors: Christopher David Bayer, Amsterdam (NL); Andreas Vogel, Leipzig (DE); Marc Struhalla, Leipzig (DE); Birgit Brucher, Leipzig (DE)

(73) Assignees: C-Lecta GmbH, Leipzig (DE); New Matterhorn, LLC, Wilmington, DE (US)

( * ) Notice: Subject to any disclaimer, the term of this patent is extended or adjusted under 35 U.S.C. 154(b) by 0 days.

This patent is subject to a terminal disclaimer.

(21) Appl. No.: 16/761,735

(22) PCT Filed: Nov. 28, 2018

(86) PCT No.: PCT/EP2018/082881
§ 371 (c)(1),
(2) Date: May 5, 2020

(87) PCT Pub. No.: WO2019/106036
PCT Pub. Date: Jun. 6, 2019

(65) Prior Publication Data
US 2021/0087598 A1   Mar. 25, 2021

(30) Foreign Application Priority Data

Nov. 28, 2017  (EP) ..................... 17204211
May 25, 2018  (EP) ..................... 18174349

(51) Int. Cl.
| C12N 9/10  | (2006.01) |
| C12N 9/92  | (2006.01) |
| C12P 19/12 | (2006.01) |
| C12P 19/18 | (2006.01) |
| C12P 19/24 | (2006.01) |

(52) U.S. Cl.
CPC .............. *C12N 9/1051* (2013.01); *C12N 9/92* (2013.01); *C12P 19/12* (2013.01); *C12P 19/18* (2013.01); *C12P 19/24* (2013.01); *C12Y 204/01007* (2013.01); *C12Y 204/01064* (2013.01)

(58) Field of Classification Search
CPC .......... C12N 9/1051; C12N 9/92; C12P 19/12
See application file for complete search history.

(56) References Cited

U.S. PATENT DOCUMENTS

| 3,335,055 A | 8/1967 | Wwidenheimer et al. |
| 4,018,889 A | 4/1977 | Armstrong |
| 4,081,528 A | 3/1978 | Armstrong |
| 4,086,332 A | 4/1978 | Armstrong |
| 5,122,519 A | 6/1992 | Ritter |
| 7,169,811 B2 | 1/2007 | de Paoli Ambrosi |
| 2011/0144003 A1 | 6/2011 | Dhuin et al. |
| 2014/0147504 A1 | 5/2014 | Salman et al. |
| 2016/0279152 A1 | 9/2016 | Chen et al. |
| 2016/0310512 A1 | 10/2016 | Audibert et al. |

FOREIGN PATENT DOCUMENTS

| CN | 1048322 A | 1/1991 |
| CN | 1528326 A | 9/2004 |
| CN | 1606462 A | 4/2005 |
| CN | 104902875 A | 9/2015 |
| EP | 0639645 A1 | 2/1995 |
| EP | 0673999 A2 | 9/1995 |
| EP | 0677587 A1 | 10/1995 |
| EP | 0976826 A1 | 2/2000 |
| GB | 1592053 | 7/1981 |
| WO | WO-2016154232 A2 | 9/2016 |

OTHER PUBLICATIONS

Studer. Residue mutations and their impact on protein structure and function: detecting beneficial and pathogenic changes. Biochem. J. (2013) 449, 581-594.*
Ren. Gene expression and molecular characterization of a thermostable trehalose phosphorylase from Thermoanaerobacter tengcongensis. Science in China Ser. C Life Sciences 2005 vol. 48 No. 3 221-227.*
Ventura. A0A087BAR6_9BIFI. UniProtKB/TrEMBL Database. Oct. 29, 2014.*
Hlima. Identification of critical residues for the activity and thermostability of *Streptomyces* sp. SK glucose isomerase. Appl. Microbiol. Biotechnol. 97:9715-9726(2013).*

(Continued)

*Primary Examiner* — Yong D Pak
(74) *Attorney, Agent, or Firm* — Blank Rome LLP

(57) ABSTRACT

The present invention relates to a method for producing trehalose, comprising the steps of mixing and reacting, in any order, (i) at least one alpha-phosphorylase capable of catalyzing the production of alpha-D-glucose 1-phosphate intermediate from a saccharide raw material, and from at least one phosphorus source; (ii) at least one trehalose phosphorylase capable of catalyzing the production of trehalose from an alpha-D-glucose 1-phosphate intermediate and a glucose substrate, wherein the trehalose phosphorylase is a trehalose phosphorylase variant with an amino acid sequence which differs from the amino acid sequence of a wild type trehalose phosphorylase in at least one amino acid position, (iii) at least one saccharide raw material which produces an alpha-D-glucose 1-phosphate intermediate and a co-product by catalytic action of the alpha-phosphorylase; and (iv) at least one phosphorus source selected from the group consisting of a phosphoric acids and an inorganic salt thereof.

Figure 1:
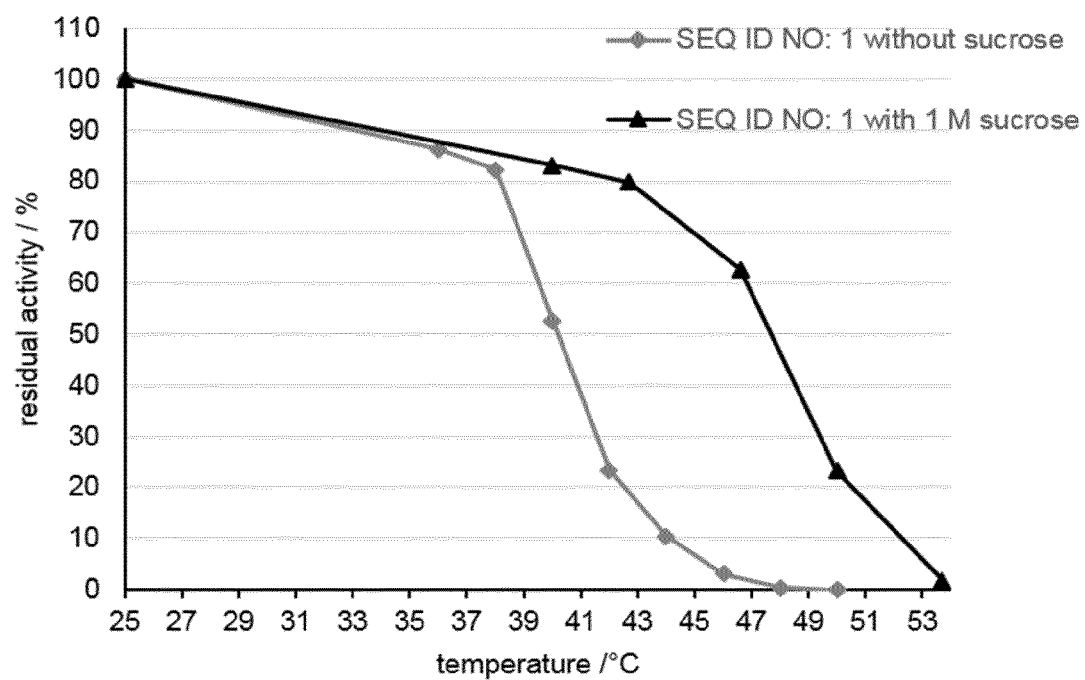

23 Claims, 2 Drawing Sheets
Specification includes a Sequence Listing.

(56) References Cited

OTHER PUBLICATIONS

Q2HZZ3_SCHCO. UniProtKB/TrEMBL Database. Mar. 16, 2016.*
Aerts et al (Biotechnology and Bioengineering, vol. 110, No. 10, 2013, 2563-2572).
Floudas, et al., DATABASE GenPept [Online] Mar. 20, 2014 (Mar. 20, 2014), trehalose phosphorylase, XP002790236, Database accession No. XP 007264093 the whole document.
Floudas, et al., DATABASE GenPept [Online] Mar. 26, 2014 (Mar. 26, 2014), trehalose synthase, XP002790238, Database accession No. XP 007364678 the whole document.
Fuji et al (Journal of Applied Glycoscience vol. 53 (2006) No. 2 p. 91-97).
Hori, et al., DATABASE UniProt [Online] Jun. 7, 2017 (Jun. 7, 2017), Full=Glycosyltransferase family 4 protein, XP002790234, Database accession No. A0A0C3NIW2 the whole document.
Hu, Database UniProt [Online] Nov. 2, 2016 (Nov. 2, 2016), Full=Trehalose phosphorylase, XP002790237, Database accession No. A0A137R1LI the whole document.
Min, et al.: Full=Trehalose phosphorylase, UNIPROT, Jun. 8, 2016 (Jun. 8, 2016), XP002767751, Database accession No. A0A151VW19 the whole document.
Silverstein et al. (The Journal of Biological Chemistry, vol. 242, No. 6, 1967, 1338-1346).
Suzuki, et al., DATABASE GenPept [Online] Mar. 27, 2014 (Mar. 27, 2014), glycosyltransferase family 4 protein, XP002790235, Database accession No. XP 007396234 the whole document.
International Search Report issued in PCT/EP2018/082881 dated Apr. 24, 2019.
International Search Report issued in PCT/IB2018/058289 dated Feb. 20, 2019.
Yu, et al., Observation on Efficacy of Combined Therapy of Oral Minocycline and 0.1% Adapalene Gel for Acne, Clin. J. Med. Offc, Jun. 30, 2012, 40:3:669-670.

* cited by examiner

METHOD FOR PRODUCING TREHALOSE EMPLOYING A TREHALOSE PHOSPHORYLASE VARIANT

This application is the U.S. national stage of International Patent Application No. PCT/EP2018/082881, filed Nov. 28, 2018, which claims the benefit of European Patent Applications 17204211.1, filed Nov. 28, 2017 and 18174349.3, filed May 25, 2018.

FIELD OF THE INVENTION

The present invention relates to a method for producing trehalose. More specifically, the present invention relates to a method for producing trehalose by the use of inexpensive saccharide raw material and different stable enzymes with high productivity via subsequent enzymatic reactions, including the steps of reacting a glucosyl monosaccharide and alpha-D-glucose 1-phosphate, converting glucose and alpha-D-glucose 1-phosphate into trehalose and inorganic phosphate. The method of the present invention includes the use of enzymes and enzyme variants with functional characteristics that result in an improved efficacy of the method of producing trehalose, such enzymes as trehalose phosphorylase, alpha-phosphorylase and/or glucose isomerase for the production of trehalose.

BACKGROUND OF THE INVENTION

Several different synthesis routes for the biotechnological production of trehalose ((2R,3S,4S,5R,6R)-2-(Hydroxymethyl)-6-[(2R,3R,4S,5S,6R)-3,4,5-trihydroxy-6-(hydroxymethyl)oxan-2-yl]oxyoxane-3,4,5-triol) have been described in the art using different raw materials like maltose, starch and sucrose, including different enzymes and different enzymatic activities.

U.S. Pat. Nos. 5,565,341, 5,643,775, and WO 1998/044116, for example, disclose a process for producing trehalose by incubating a saccharide raw material and a phosphoric acid and/or an inorganic salt thereof in the presence of phosphorylase to produce α-glucose 1-phosphate, and contacting the produced α-glucose 1-phosphate with glucose in the presence of a trehalose phosphorylase. Phosphorylases are enzymes that catalyze the addition of a phosphate group from an inorganic phosphate to an acceptor molecule.

Phosphorylases that catalyse the reversible phosphorolytic cleavage of trehalose are known in the art and referred to as trehalose phosphorylases. Trehalose phosphorylases can be distinguished based on the mechanism underlying the reaction catalysed by them.

A first group of trehalose phosphorylases catalyzes phosphorolytic cleavage of trehalose with net retention of the anomeric configuration using inorganic phosphate as a glucosyl acceptor into glucose and alpha-D-glucose 1-phosphate (aG1P) and are therefore classified as retaining phosphorylases. Trehalose phosphorylases of such first group have been assigned EC number EC 2.4.1.231 by the International Union of Biochemistry and Molecular Biology and have been functionally characterized from various eukaryotic fungi.

A second group of trehalose phosphorylases are inverting trehalose phosphorylases to which EC number EC 2.4.1.64 has been assigned and which are catalyzing phosphorolytic cleavage of trehalose with inversion of configuration into glucose and beta-D-glucose 1-phosphate. These phosphorylases thus have a reaction mechanism different from EC 2.4.1.231 trehalose phosphorylases.

Specifically, the present invention takes into account certain phosphorylases of EC number EC 2.4.1.231 that are capable of converting, among other reactions, glucose and alpha-D-glucose-1 phosphate ("aG1P") to trehalose, or of phosphorolytic cleavage of trehalose to glucose and aG1P in the presence of inorganic phosphate.

The industrial use of trehalose phosphorylases results from the fact that the reaction underlying their biochemical characterization, i.e. catalyzing phosphorolytic cleavage of trehalose, is reversible. Because of this, trehalose phosphorylases are particularly useful for catalyzing the conversion of glucose and aG1P to trehalose and inorganic phosphate.

The reaction catalyzed by trehalose phosphorylases is reversible (equilibrium reaction) and may undergo substrate or product inhibition, depending on the specific direction of the reaction. In order to obtain industrially relevant amounts of a desired product, trehalose phosphorylases are required that catalyze the conversion of substrates with high specific activity. In addition, other kinetic factors of the trehalose phosphorylases, such as substrate selectivity and $K_M$ may play an important role for product yields. Other relevant aspects may include but are not limited to regioselectivity, inhibition by other factors (e.g. crude extract components, substrate contaminants or side products), and recombinant soluble expression in suitable hosts.

A major shortcoming of wild type trehalose phosphorylases is the rapid loss of enzyme activity in solution even at moderate temperatures between 25° C. and 40° C., which significantly limits their application. For industrial applications, high stability over several days at temperatures above 30° C., or even better above 40° C. is desirable. Long reaction times with thermally instable enzymes requires larger amounts of enzyme over process time, often realized by repeated addition of enzyme throughout the process. For example, trehalose phosphorylase from *Pleurotus ostreatus* shows a half-life of approximately 1.3 h at 25° C. and of 3 min at approximately 41° C. (Schwarz et al., J Biotechnol 129, 140-150 (2007), Han et al., Protein Expression and Purification 30, 194-202 (2003)). The trehalose phosphorylases from *Schizophyllum commune* and *Grifola frondosa* are slightly more stable with half-lives of 4.8 h at 30° C. and of 1 h at 37° C., respectively (Schwarz et al., J Biotechnol 129, 140-150 (2007)).

Various strategies were applied in the art to address such shortcomings. For example, addition of trehalose, glycerol and polyethylene glycol (PEG) was shown to increase trehalose phosphorylases stability (Klimacek et al., Biotechnology Techniques 13: 243-248, 1999, Eis et al., Biochem J 341, 385-393 (1999), Schwarz et al. J Biotechnol 129, 140-150 (2007)). The best stabilization was achieved by adding 20% PEG 4000, which resulted in half-lives of trehalose phosphorylase from *Schizophyllum commune* at 30° C., 40° C. and 50° C. of 4.5 days, 2.2 hours and 6 min, respectively (Klimacek et al., Biotechnology Techniques 13: 243-248, 1999, Eis et al., Biochem J 341, 385-393 (1999)). While the addition of PEG 4000 improved the stability of the enzyme, such improvement is still insufficient for applications at or above 40° C. and process times of several hours to several days. The presence of PEG 4000 may furthermore interfere with industrial scale cost structure and downstream processing requirements for the products obtained by the enzymatic reaction.

Half-life of trehalose phosphorylases from *Schizophyllum commune* could also be improved by immobilization to 22 days, 3.3 days and 2 hours at 30° C., 40° C. and 50° C., respectively (Klimacek et al., Biotechnology Techniques 13: 243-248, 1999). Immobilization, however, results in higher enzyme production costs due to expensive carrier and manufacturing costs, and is efficient in terms of industrial applicability only if the enzyme can be recovered and reused for multiple cycles. Additionally, immobilization limits process and down-stream processing options for products of the enzymatic reaction.

It is therefore not surprising that synthesis reactions employing trehalose phosphorylases are conducted at temperatures ranging from 25° C. to 35° C. (Schwarz et al., J of Biotechnology 129 140-150 (2007), Saito et al., Appl Microbiol Biotechnol 50:193-198 (1998), Saito et al. Appl Microbiol Biotechnol 64: 4340-4345 (1998)).

Generally, in the field of enzyme catalysis, higher reaction temperatures accelerate product formation rate, thereby increasing the space time yield of product. The space time yield of the product formation is a value that describes the amount of product manufactured per reaction volume (usually indicated in Liter) during the reaction time. The product formation rate is a function of temperature within the range of enzyme stability at this temperature. For this reason, enzymes with sufficient thermal stability are necessary to enable improved space time yields. Thermal enzyme stability usually correlates with process stability over long time periods. Process-stable enzymes enable reactions at moderate temperatures, but for longer process times per unit of initial enzyme activity added at the start of the reaction. However, increased space time yields at elevated temperatures or longer process times may certainly also be realized with instable enzymes through increased enzyme activity input; this, however, significantly decreases space time yield per enzyme unit and increases enzyme cost contributions to the process. Thermal stability of enzymes instead lowers cost contribution.

A further approach for improving performance of enzymes and their suitability for use in industrial processes is enzyme engineering. This technique involves developing variants of a starting enzyme with improved properties (for review, see, for example, S. Lutz, U. T. Bornscheuer, Protein Engineering Handbook, Wiley VCH, Weinheim, 2009). Among others, phosphorylases were improved by enzyme engineering. For example, US 2013-0029384 discloses variants of a sucrose phosphorylase belonging to glycosyl hydrolase family 13 having improved thermal stability. Variants of trehalose phosphorylase of EC number EC 2.4.1.231 have so far been limited to variants for elucidation of the reaction mechanism of said trehalose phosphorylase. Based on such variants. Goedl et al. (Biochem J 397; 491-500; 2006) discovered that substitutions at amino acid positions D379, H403, R507 and K512 of trehalose phosphorylase from *Shizophyllum commune* led to a reduction in activity. The variants having one of the following single mutations D379N, H403A, R507A and K512A showed reduced activity for trehalose phosphorolysis. Goedl et al. (FEBS J 275; 903-913, 2008) more specifically found that mutations R507A and K512A of trehalose phosphorylase from *Shizophyllum commune* had an impact on catalytic efficiency of trehalose phosphorylase of the wild type (kcat/$K_M$).

As the wild type trehalose phosphorylases available in the art are not satisfactory in every respect for enzymatic processes for the production of trehalose, and as attempts to efficiently improve the industrial applicability of trehalose phosphorylases as described in the art were not successful, there is a need for improved methods for the industrial production of trehalose by employing new trehalose phosphorylases which are advantageous compared to wild type trehalose phosphorylases, in particular with respect to process stability at high temperatures.

Accordingly, the problem underlying the present invention is the provision of an improved manufacturing process for the industrial production of trehalose.

This problem is solved by the method of the present invention in the form of a two-enzyme, preferably in the form of a three-enzyme process, employing improved trehalose phosphorylase sequence variants derived from enzyme candidates sequences known in the art, and in particular derived from sequences of two different organisms, that are of highest impact for process efficiency. Sucrose phosphorylase and glucose isomerase candidates and sequence variants thereof are also employed in the context of present invention, thereby allowing for a trehalose production process with increased efficacy.

DETAILED DESCRIPTION OF THE INVENTION

In a first aspect, the invention relates to a method for producing trehalose, comprising the steps of mixing and reacting, in any order, a) at least one alpha-phosphorylase capable of catalyzing the production of alpha-D-glucose 1-phosphate intermediate from a saccharide raw material selected from the group consisting of sucrose and starch, and from at least one phosphorus source selected from the group consisting of a phosphoric acid and an inorganic salt thereof;

b) at least one trehalose phosphorylase capable of catalyzing the production of trehalose from a alpha-D-glucose 1-phosphate intermediate and a glucose substrate, wherein the trehalose phosphorylase is a trehalose phosphorylase variant with an amino acid sequence which differs from the amino acid sequence of a wild type trehalose phosphorylase in at least one amino acid position;

c) at least one saccharide raw material selected from the group consisting of sucrose and starch which produces a alpha-D-glucose 1-phosphate intermediate and a co-product selected from the group of fructose co-product and starch co-product by catalytic action of the alpha-phosphorylase; and d) at least one phosphorus source selected from the group consisting of a phosphoric acid and an inorganic salt thereof.

In a preferred embodiment, the method further comprises the step of mixing and reacting, in any order, a glucose substrate with the at least one alpha-phosphorylase, the at least one trehalose phosphorylase, the at least one saccharide raw material selected from the group consisting of sucrose and starch, and the at least one phosphorus source.

In another preferred embodiment, the method further comprises the step of mixing and reacting, in any order, at least one glucose isomerase with the at least one alpha-phosphorylase, the at least one trehalose phosphorylase, the at least one saccharide raw material selected from the group consisting of sucrose and starch, and the at least one phosphorus source.

In another preferred embodiment of the first aspect, which is also a preferred embodiment of all embodiments relating thereto, the method is characterized in that the glucose substrate is either produced from a fructose co-product by catalytic action of the at least one glucose isomerase and/or in that the glucose substrate is supplemented in a separate step as an external reactant, in any order.

In the context of the present invention, it is specifically understood that the at least one alpha-phosphorylase will convert sucrose as a saccharide raw material into an alpha-D-glucose 1-phosphate intermediate and fructose co-product. In the presence of the at least one glucose isomerase, the fructose co-product may be further converted to glucose that may then be used as a glucose substrate for the conversion of the at least one trehalose phosophorylase. In addition, and at least partially, glucose substrate may be separately supplemented to the reaction according to the method of the present invention in the presence of the at least one glucose isomerase. In the absence of glucose isomerase, the method requires a separate supplementation of glucose substrate for the conversion by the at least one trehalose phosophorylase.

In yet another preferred embodiment, the method is characterized by the presence of two or more of the following conversions selected from the group consisting of:
a) the conversion of the at least one saccharide raw material through phosphorolytic cleavage by the at least one alpha-phosphorylase and the at least one phosphorous source into alpha-D-glucose 1-phosphate intermediate and a co-product:
b) the conversion of an alpha-D-glucose 1-phosphate intermediate and a glucose substrate into trehalose by the at least one trehalose phosphorylase;
c) the conversion of the fructose co-product into a glucose substrate by the at least one glucose isomerase.

In the context of the present invention, the at least one alpha-phosphorylase is an enzyme that catalyses the phosphorolytic cleavage of sucrose or starch by using phosphate as a glucosyl acceptor into alpha-D-glucose 1-phosphate (aG1P). The at least one alpha-phosphorylase is preferably a sucrose phosphorylase or a glucan phosphporylase (e.g. a glucan phosphorylase as defined by EC 2.4.1.1). Most preferably, the alpha-phosphorylase is a sucrose phosphorylase, wherein the sucrose phosphorylase (also referred to as "SP" or as "SP enzyme") is preferably defined by the enzyme classification EC 2.4.1.7, while the at least one trehalose phosphorylase is preferably a trehalose phosphorylase (also referred to as "TP" or as "TP enzyme") as defined by the enzyme classification EC 2.4.1.231. The at least one glucose isomerase (also referred to as "GI" or as "GI enzyme") of the invention is preferably a xylose isomerase as defined by the enzyme classification EC 5.3.1.5.

In another preferred embodiment, the method of the invention is characterized as
a) a two-enzyme process, involving the reacting and mixing of the at least one alpha-phosphorylase, the at least one trehalose phosphorylase, the at least one saccharide raw material, the glucose substrate and the at least one phosphorus source; and/or
b) a three-enzyme process, involving the reacting and mixing of the at least one alpha-phosphorylase, preferably wherein the at least one alpha-phosphorylase is sucrose phosphorylase, the at least one trehalose phosphorylase, the at least one glucose isomerase, the at least one saccharide raw material, preferably wherein the saccharide raw material is sucrose, and the at least one phosphorus source; and/or
c) a three-enzyme process, involving the reacting and mixing of the at least one alpha-phosphorylase, the at least one trehalose phosphorylase, the at least one glucose isomerase, the at least one saccharide raw material, and the glucose substrate and the at least one phosphorus source.

In the context of the present invention, it is to be understood that the method for producing trehalose may be performed as a two-enzyme process in the presence of the at least one alpha-phosphorylase and the at least one trehalose phosphorylase. Irrespective of using sucrose and/or starch as a saccharide raw material, the glucose substrate needs to be supplemented to the reaction, and starch co-product and/or fructose co-product will be produced in equimolar amounts to trehalose.

In yet another preferred embodiment, the method of the invention is characterized by the presence of two or more of the following conversions selected from the group consisting of:
a) the conversion of the at least one saccharide raw material through phosphorolytic cleavage by the at least one alpha-phosphorylase and the at least one phosphorous source into alpha-D-glucose 1-phosphate intermediate and a co-product;
b) the conversion of an alpha-D-glucose 1-phosphate intermediate and a glucose substrate into trehalose by the at least one trehalose phosphorylase;
the conversion of the fructose co-product into a glucose substrate by the at least one glucose isomerase;
wherein the glucose substrate of step b) is supplemented to the conversion or is obtained in step c).

It is also understood in the context of the present invention that the method for producing trehalose may be performed as a three-enzyme process in the presence of the at least one alpha-phosphorylase, the at least one glucose isomerase and the at least one trehalose phosphorylase. Upon using sucrose as the at least one saccharide raw material, no glucose substrate needs to be added to the reaction, but will be produced in situ through conversion of fructose by catalysis of glucose isomerase, thereby reducing the yields of fructose co-product. Irrespective thereof, glucose substrate may optionally be supplemented. In a three-enzyme process using starch as the at least one saccharide raw material, the at least one glucose isomerase cannot convert starch co-products to glucose in situ, and glucose substrate needs to be supplemented.

Preferably, the at least one or more of the conversions is/are performed in separate vessels. In the context of the present invention, the feature "performed in separate vessels" means that one or more individual conversion steps are carried out independently from each other. Specifically, the one and more individual conversion steps being performed in different vessels are carried out sequentially.

In the context of the present invention, it is further understood that for a two-enzyme process being performed in different separate vessels, preferably being sequentially performed in different separate vessels, specifically, in a first individual conversion step, the production of alpha-glucose 1-phosphate through alpha-phosphorylase may be carried out, while in a second step, alpha-glucose 1-phosphate is reacted with glucose through a trehalose phosphorylase. For the three-enzyme process being performed in different vessels, preferably being sequentially performed in different vessels, specifically, the first conversion of alpha-phosphorylase in a first vessel, the second conversion of glucose isomerase in a second vessel, and the third conversion of trehalose phosphorylase in a third vessel may each be individually performed, or as a first alternative, the first conversion of alpha-phosphorylase and the second conversion of glucose isomerase may be combined in a first vessel, followed by the third conversion of trehalose phosphorylase in a second vessel, or as a second alternative the first conversion of alpha-phosphorylase may be performed in a first vessel, followed by the second and third conversions of glucose isomerase and trehalose phosphorylase in a second vessel.

More preferably, the reaction products from each separate vessel can be purified from the reaction broth before performing the subsequent conversion in another separate vessel. Specifically individual reaction products can be separated from each other, for example desired products from unwanted side products, before performing the subsequent conversion in a separate vessel. Suitable means and methods or the purification of one or more individual reaction products from a particular reaction broth and/or for separating reaction products from each other are known to the skilled person.

Equally preferred is that the at least one or more of the conversions is/are performed in the same vessel. In the context of the present invention, the feature "performed in the same vessel" means that the individual reaction steps are carried out in one reaction environment, allowing that the production flow and/or the kinetics of the individual conversions and the formation of corresponding reaction intermediates or products can be influenced and/or shifted in one or the other direction by the addition and/or subtraction and/or inactivation, e.g. through chemical or thermal inactivation, of the individual components or input material. Specifically, the saccharide raw materials, phosphorous source, glucose substrate and any of the enzymes may be added in any order herein. The glucose substrate may be formed in situ (for example, by reaction of the fructose co-product with the glucose isomerase) and/or added to the reaction mixture.

In a preferred embodiment of the first aspect, which is also a preferred embodiment of all embodiments related thereto, the method is characterized in that a) for the two-enzyme process, the at least one alpha-phosphorylase, the at least one trehalose phosphorylase, the at least one saccharide raw material, the glucose substrate, and the at least one phosphorus source are mixed simultaneously or sequentially in any order; and/or b) for the three-enzyme process, the at least one alpha-phosphorylase, the at least one trehalose phosphorylase, the at least one glucose isomerase, the at least one saccharide raw material, and the at least one phosphorus source are mixed simultaneously or sequentially in any order; and/or c) for a three-enzyme process, the at least one alpha-phosphorylase, the at least one trehalose phosphorylase, the at least one glucose isomerase, the at least one saccharide raw material, the glucose substrate, and the at least one phosphorus source are mixed simultaneously or sequentially in any order.

In the context of the invention, the term "in any order" includes performing the steps either sequentially or simultaneously, such as by mixing and/or reacting the saccharide raw material, phosphorous source, optional glucose substrate, and/or any of the enzymes. Specifically, it may be useful in industrial scale production to pre-mix certain substrates and/or certain enzymes and then to initiate the conversion by addition of other substrates and/or enzymes, or it may be useful to modulate activity of an enzyme through dosing a certain substrate. For example, all saccharide raw material, phosphorous source, optional glucose substrate, and any of the enzymes except the at least one alpha-phosphorylase may be pre-mixed, and the reaction is then started by addition of the at least one alpha-phosphorylase, which catalyzes the first individual conversion step. For the purpose of the invention, the term "in any order" also includes, during the time course of the overall reaction, adding to the mixture sequentially or supplementing at multiple times during the reaction the saccharide raw materials, phosphorous source, optional glucose substrate, any of the enzymes, or any combination of any of the foregoing.

In the context of this invention the term "mixing" describes the act of bringing the reactants, namely the the saccharide raw material, phosphorous source, optional glucose substrate, and/or any of the enzymes, into contact. The act of "mixing" may include for example (i) pouring the reactants into a reaction vessel, (ii) the release of one or more certain reactants from a separated compartment into a reaction vessel containing other reactants (for example the release of enzymes from an intact cell by means of cell lysis or homogenization into a medium containing the other reactants), or (iii) passing a reactant solution without enzymes over enzymes immobilized in a fixed bed reactor, wherein each of these procedures (i)-(iii) may furthermore include physical agitation, like stirring or shaking.

Suitable inorganic salts of phosphoric acid for use in the methods of the present invention include, but are not limited to, potassium phosphates and sodium phosphates.

In one embodiment, the phosphorous source is present at 0.1 mmol to 10 mol, such as 1 mmol to 1 mol, or such as 10 mmol to 400 mmol for 1 kg of the saccharide raw material.

Suitable starches for use in the methods of the present invention include, but are not limited to, soluble starch, starch, glycogen, dextrin and glucan.

Preferably, the method is carried out at a temperature of at least 20° C. up to 80° C., preferably of at least 30° C. up to 80° C., preferably of at least 39° C. up to 80° C., more preferably of at least 40° C. up to 80° C., more preferably of at least 39° C. up to 60° C., even more preferably of at least 40° C. up to 60° C., and most preferably of at least 45° C. up to 60° C.

Even more preferably, the method is carried out at a temperature of at least 20° C. up to 80° C., 21° C. up to 80° C. 22° C. up to 80° C. 23'C up to 80° C. 24° C. up to 80° C. 25° C. up to 80° C., 26° C. up to 80° C. 27'C up to 80° C. 28° C. up to 80° C. 29° C. up to 80° C., preferably of at least 30° C. up to 80° C., 31° C. up to 80° C. 32° C. up to 80° C., 33° C. up to 80° C. 34° C. up to 80° C. 35° C. up to 80° C., 36° C. up to 80° C., 37° C. up to 80° C., 38° C. up to 80'C, 39° C. up to 80° C. more preferably of at least 40° C. up to 80° C., 41'C up to 80° C. 42° C. up to 80° C., 43'C up to 80° C., 44° C. up to 80° C., 45° C. up to 80° C., 46° C. up to 80° C., 47° C. up to 80° C. 48° C. up to 80° C., 49° C. up to 80° C., even more preferably of at least 39° C. up to 60° C., 40° C. up to 60° C. 41° C. up to 60° C. 42'C up to 60° C. 43° C. up to 60° C., 44° C. up to 60° C., 45° C. up to 60° C. 46° C. up to 60'C. 47'C up to 60° C. 48° C. up to 60° C., 49° C. up to 60° C. and most preferably of at least 45° C. up to 60° C.

It is understood in the meaning of the invention that for each individual conversion performed in the course of the method, a specific temperature may be optimal. In an even more preferred embodiment of the invention, one or more conversions of the method are individually carried out at a temperature of at least 20° C. up to 80° C. 21° C. up to 80° C. 22° C. up to 80° C., 23° C. up to 80° C., 24° C. up to 80° C. 25° C. up to 80° C. 26° C. up to 80° C., 27° C. up to 80° C. 28° C. up to 80° C., 29° C. up to 80° C., preferably of at least 30° C. up to 80° C., 31° C. up to 80° C. 32° C. up to 80° C., 33° C. up to 80° C. 34° C. up to 80° C. 35° C. up to 80° C. 36° C. up to 80° C., 37° C. up to 80° C. 38° C. up to 80° C., 39° C. up to 80° C., more preferably of at least 40° C. up to 80° C., 41° C. up to 80° C., 42° C. up to 80° C. 43° C. up to 80° C. 44° C. up to 80° C. 45'C up to 80° C. 46° C. up to 80° C., 47° C. up to 80° C. 48° C. up to 80° C. 49° C. up to 80° C., even more preferably of at least 39'C up to 60° C. 40'C up to 60° C., 41° C. up to 60° C., 42'C up to 60° C. 43° C. up to 60° C., 44° C. up to 60° C. 45° C. up to 60°

C., 46° C. up to 60° C. 47° C. up to 60° C., 48° C. up to 60° C. 49° C. up to 60° C. and most preferably of at least 45° C. up to 60° C. Most preferably, at least any step in the method enclosing the conversion of a alpha-D-glucose 1-phosphate intermediate and a glucose substrate by a trehalose phosphorylase is carried out at a temperature of at least 20° C. up to 80° C. 21° C. up to 80° C. 22° C. up to 80° C. 23° C. up to 80° C., 24'C up to 80° C., 25° C. up to 80° C. 26° C. up to 80° C. 27° C. up to 80° C., 28° C. up to 80° C., 29° C. up to 80° C., preferably of at least 30° C. up to 80° C., 31° C. up to 80° C. 32° C. up to 80° C. 33° C. up to 80° C. 34° C. up to 80° C., 35° C. up to 80° C., 36° C. up to 80° C., 37° C. up to 80° C., 38° C. up to 80° C. 39° C. up to 80° C., more preferably of at least 40° C. up to 80° C., 41° C. up to 80° C. 42° C. up to 80° C., 43° C. up to 80° C. 44° C. up to 80° C., 45° C. up to 80° C., 46° C. up to 80° C. 47° C. up to 80'C, 48° C. up to 80° C. 49° C. up to 80° C., even more preferably of at least 39° C. up to 60° C., 40° C. up to 60° C., 41° C. up to 60° C. 42° C. up to 60° C. 43° C. up to 60° C., 44° C. up to 60° C., 45° C. up to 60° C., 46° C. up to 60° C., 47° C. up to 60° C., 48° C. up to 60° C. 49° C. up to 60° C., and most preferably of at least 45° C. up to 60° C.

In one embodiment, the at least one saccharide raw material is mixed and reacted in form of sucrose or starch, preferably wherein the sucrose or starch is added to the reaction in a concentration range of from 1 mM up to 2000 mM, such as from 100 mM up to 2000 mM, or from 500 mM to 2000 mM, or from 1000 mM to 2000 mM.

Preferably, the at least one saccharide raw material is mixed and reacted in form of sucrose, preferably wherein the sucrose is added to the reaction in a concentration range of from 100 mM up to 2000 mM, preferable of from 500 mM to 2000 mM, more preferably of from 1000 mM to 2000 mM.

Even more preferably, the at least one saccharide raw material is mixed and reacted in form of sucrose, preferably wherein the sucrose is added to the reaction in a concentration range of from 100 mM up to 2000 mM, 200 mM up to 2000 mM, 300 mM up to 2000 mM, 400 mM up to 2000 mM, 500 mM up to 2000 mM, 600 mM up to 2000 mM, 700 mM up to 2000 mM, 800 mM up to 2000 mM, 900 mM up to 2000 mM, 1000 mM up to 2000 mM, 1100 mM up to 2000 mM, 1200 mM up to 2000 mM, 1300 mM up to 2000 mM, 1400 mM up to 2000 mM, 1500 mM up to 2000 mM, 1600 mM up to 2000 mM, 1700 mM up to 2000 mM, 1800 mM up to 2000 mM, 1900 mM up to 2000 mM, preferably in the range of 500 mM up to 2000 mM, 600 mM up to 2000 mM, 700 mM up to 2000 mM, 800 mM up to 2000 mM, 900 mM up to 2000 mM, 1000 mM up to 2000 mM, 1100 mM up to 2000 mM, 1200 mM up to 2000 mM, 1300 mM up to 2000 mM, 1400 mM up to 2000 mM, 1500 mM up to 2000 mM, 1600 mM up to 2000 mM, 1700 mM up to 2000 mM, 1800 mM up to 2000 mM, 1900 mM up to 2000 mM, and more preferably in the range of 1000 mM up to 2000 mM, 1100 mM up to 2000 mM, 1200 mM up to 2000 mM, 1300 mM up to 2000 mM, 1400 mM up to 2000 mM, 1500 mM up to 2000 mM, 1600 mM up to 2000 mM, 1700 mM up to 2000 mM, 1800 mM up to 2000 mM, 1900 mM up to 2000 mM.

In a preferred embodiment, the method of the invention is carried out as a three-enzyme process comprising the steps of mixing and reacting, in any order, of at least one saccharide raw material, at least one phosphorous source, at least one alpha-phosphorylase, preferably a sucrose phosphorylase, at least one glucose isomerase and at least one trehalose phosphorylase, wherein the method is characterized by the use of an at least one trehalose phosphorylase (TP), wherein the at least one trehalose phosphorylase enables a Productivity per kU of TP enzyme of trehalose from the saccharide raw material sucrose of at least 1.0 g/(L*h) per kU TP to 100 g/(L*h) per kU TP, at least 1.1 g/(L*h) per kU TP to 100 g/(L*h) per kU TP, at least 1.2 g/(L*h) per kU TP to 100 g/(L*h) per kU TP, at least 1.3 g/(L*h) per kU TP to 100 g/(L*h) per kU TP, at least 1.4 g/(L*h) per kU TP to 100 g/(L*h) per kU TP, at least 1.5 g/(L*h) per kU TP to 100 g/(L*h) per kU TP, preferably at least 1.6 g/(L'h) per kU TP up to 100 g/(L*h) per kU TP, at least 1.7 g/(L*h) per kU TP up to 100 g/(L*h) per kU TP, even more preferably at least 1.8 g/(L*h) per kU TP up to 100 g/(L*h) per kU TP, at least 1.9 g/(L*h) per kU TP up to 100 g/(L*h) per kU TP, at least 2 g/(L*h) per kU TP up to 100 g/(L*h) per kU TP, at least 2.1 g/(L*h) per kU TP up to 100 g/(L*h) per kU TP, at least 2.2 g/(L*h) per kU TP up to 100 g/(L*h) per kU TP, at least 2.3 g/(L*h) per kU TP up to 100 g/(L*h) per kU TP, at least 2.4 g/(L*h) per kU TP up to 100 g/(L*h) per kU TP, at least 2.5 g/(L*h) per kU TP up to 100 g/(L*h) per kU TP, or at least 1.0 g/(L*h) per kU TP up to 90 g/(L*h) per kU TP, at least 1.0 g/(L*h) per kU TP up to 80 g/(L*h) per kU TP, at least 1.0 g/(L*h) per kU TP up to 70 g/(L*h) per kU TP, at least 1.0 g/(L*h) per kU TP up to 60 g/(L*h) per kU TP, at least 1.0 g/(L*h) per kU TP up to 50 g/(L*h) per kU TP, at least 1.0 g/(L*h) per kU TP up to 40 g/(L*h) per kU TP, at least 1.0 g/(L*h) per kU TP up to 30 g/(L*h) per kU TP, at least 1.0 g/(L*h) per kU TP up to 25 g/(L*h) per kU TP, at least 1.0 g/(L*h) per kU TP up to 20 g/(L*h) per kU TP, at least 1.0 g/(L*h) per kU TP up to 15 g/(L*h) per kU TP, at least 1.0 g/(L*h) per kU TP up to 10 g/(L*h) per kU TP, or at least 1.6 g/(L*h) per kU TP up to 90 g/(L*h) per kU TP, at least 1.6 g/(L*h) per kU TP up to 80 g/(L*h) per kU TP, at least 1.6 g/(L*h) per kU TP up to 70 g/(L*h) per kU TP, at least 1.6 g/(L*h) per kU TP up to 60 g/(L*h) per kU TP, at least 1.6 g/(L*h) per kU TP up to 50 g/(L*h) per kU TP, at least 1.6 g/(L*h) per kU TP up to 40 g/(L*h) per kU TP, at least 1.6 g/(L*h) per kU TP up to 30 g/(L*h) per kU TP, at least 1.6 g/(L*h) per kU TP up to 25 g/(L*h) per kU TP, at least 1.6 g/(L*h) per kU TP up to 20 g/(L*h) per kU TP, at least 1.6 g/(L*h) per kU TP up to 15 g/(L*h) per kU TP, at least 1.6 g/(L*h) per kU TP up to 10 g/(L*h) per kU TP, or at least 1.8 g/(L*h) per kU TP up to 90 g/(L*h) per kU TP, at least 1.8 g/(L*h) per kU TP up to 80 g/(L*h) per kU TP, at least 1.8 g/(L*h) per kU TP up to 70 g/(L*h) per kU TP, at least 1.8 g/(L*h) per kU TP up to 60 g/(L*h) per kU TP, at least 1.8 g/(L*h) per kU TP up to 50 g/(L*h) per kU TP, at least 1.8 g/(L*h) per kU TP up to 40 g/(L*h) per kU TP, at least 1.8 g/(L*h) per kU TP up to 30 g/(L*h) per kU TP, at least 1.8 g/(L*h) per kU TP up to 25 g/(L*h) per kU TP, at least 1.8 g/(L*h) per kU TP up to 20 g/(L*h) per kU TP, at least 1.8 g/(L*h) per kU TP up to 15 g/(L*h) per kU TP, at least 1.8 g/(L*h) per kU TP up to 10 g/(L*h) per kU TP, or at least 2.0 g/(L*h) per kU TP up to 90 g/(L*h) per kU TP, at least 2.0 g/(L*h) per kU TP up to 80 g/(L*h) per kU TP, at least 2.0 g/(L*h) per kU TP up to 70 g/(L*h) per kU TP, at least 2.0 g/(L*h) per kU TP up to 60 g/(L*h) per kU TP, at least 2.0 g/(L*h) per kU TP up to 50 g/(L*h) per kU TP, at least 2.0 g/(L*h) per kU TP up to 40 g/(L*h) per kU TP, at least 2.0 g/(L*h) per kU TP up to 30 g/(L*h) per kU TP, at least 2.0 g/(L*h) per kU TP up to 25 g/(L*h) per kU TP, at least 2.0 g/(L*h) per kU TP up to 20 g/(L*h) per kU TP, at least 2.0 g/(L*h) per kU TP up to 15 g/(L*h) per kU TP, or at least 2.0 g/(L*h) per kU TP up to 10 g/(L*h) per kU TP.

Preferably, the method of the invention is carried out as a three-enzyme process comprising the steps of mixing and reacting, in any order, at least one saccharide raw material, at least one phosphorous source, at least one alpha-phosphorylase, preferably a sucrose phosphorylase, at least one glucose isomerase and at least one trehalose phosphorylase, wherein the Productivity per kU of TP enzyme of trehalose from the saccharide raw material sucrose is at least 1.0 g/(L*h) per kU TP to 100 g/(L*h) per kU TP, at least 1.1 g/(L*h) per kU TP to 100 g/(L*h) per kU TP, at least 1.2 g/(L*h) per kU TP to 100 g/(L*h) per kU TP, at least 1.3 g/(L*h) per kU TP to 100 g/(L*h) per kU TP, at least 1.4 g/(L*h) per kU TP to 100 g/(L*h) per kU TP, at least 1.5 g/(L*h) per kU TP to 100 g/(L*h) per kU TP, preferably at least 1.6 g/(L*h) per kU TP up to 100 g/(L*h) per kU TP, at least 1.7 g/(L*h) per kU TP up to 100 g/(L*h) per kU TP, even more preferably at least 1.8 g/(L*h) per kU TP up to 100 g/(L*h) per kU TP, at least 1.9 g/(L*h) per kU TP up to 100 g/(L*h) per kU TP, at least 2 g/(L*h) per kU TP up to 100 g/(L*h) per kU TP, at least 2.1 g/(L*h) per kU TP up to 100 g/(L*h) per kU TP, at least 2.2 g/(L*h) per kU TP up to 100 g/(L*h) per kU TP, at least 2.3 g/(L*h) per kU TP up to 100 g/(L*h) per kU TP, at least 2.4 g/(L*h) per kU TP up to 100 g/(L*h) per kU TP, at least 2.5 g/(L*h) per kU TP up to 100 g/(L*h) per kU TP, or at least 1.0 g/(L*h) per kU TP up to 90 g/(L*h) per kU TP, at least 1.0 g/(L*h) per kU TP up to 80 g/(L*h) per kU TP, at least 1.0 g/(L*h) per kU TP up to 70 g/(L*h) per kU TP, at least 1.0 g/(L*h) per kU TP up to 60 g/(L*h) per kU TP, at least 1.0 g/(L*h) per kU TP up to 50 g/(L*h) per kU TP, at least 1.0 g/(L*h) per kU TP up to 40 g/(L*h) per kU TP, at least 1.0 g/(L*h) per kU TP up to 30 g/(L*h) per kU TP, at least 1.0 g/(L*h) per kU TP up to 25 g/(L*h) per kU TP, at least 1.0 g/(L*h) per kU TP up to 20 g/(L*h) per kU TP, at least 1.0 g/(L*h) per kU TP up to 15 g/(L*h) per kU TP, at least 1.0 g/(L*h) per kU TP up to 10 g/(L*h) per kU TP, or at least 1.6 g/(L*h) per kU TP up to 90 g/(L*h) per kU TP, at least 1.6 g/(L*h) per kU TP up to 80 g/(L*h) per kU TP, at least 1.6 g/(L*h) per kU TP up to 70 g/(L*h) per kU TP, at least 1.6 g/(L*h) per kU TP up to 60 g/(L*h) per kU TP, at least 1.6 g/(L*h) per kU TP up to 50 g/(L*h) per kU TP, at least 1.6 g/(L*h) per kU TP up to 40 g/(L*h) per kU TP, at least 1.6 g/(L*h) per kU TP up to 30 g/(L*h) per kU TP, at least 1.6 g/(L*h) per kU TP up to 25 g/(L*h) per kU TP, at least 1.6 g/(L*h) per kU TP up to 20 g/(L*h) per kU TP, at least 1.6 g/(L*h) per kU TP up to 15 g/(L*h) per kU TP, at least 1.6 g/(L*h) per kU TP up to 10 g/(L*h) per kU TP, or at least 1.8 g/(L*h) per kU TP up to 90 g/(L*h) per kU TP, at least 1.8 g/(L*h) per kU TP up to 80 g/(L*h) per kU TP, at least 1.8 g/(L*h) per kU TP up to 70 g/(L*h) per kU TP, at least 1.8 g/(L*h) per kU TP up to 60 g/(L*h) per kU TP, at least 1.8 g/(L*h) per kU TP up to 50 g/(L*h) per kU TP, at least 1.8 g/(L*h) per kU TP up to 40 g/(L*h) per kU TP, at least 1.8 g/(L*h) per kU TP up to 30 g/(L*h) per kU TP, at least 1.8 g/(L*h) per kU TP up to 25 g/(L*h) per kU TP, at least 1.8 g/(L*h) per kU TP up to 20 g/(L*h) per kU TP, at least 1.8 g/(L*h) per kU TP up to 15 g/(L*h) per kU TP, at least 1.8 g/(L*h) per kU TP up to 10 g/(L*h) per kU TP, or at least 2.0 g/(L*h) per kU TP up to 90 g/(L*h) per kU TP, at least 2.0 g/(L*h) per kU TP up to 80 g/(L*h) per kU TP, at least 2.0 g/(L*h) per kU TP up to 70 g/(L*h) per kU TP, at least 2.0 g/(L*h) per kU TP up to 60 g/(L*h) per kU TP, at least 2.0 g/(L*h) per kU TP up to 50 g/(L*h) per kU TP, at least 2.0 g/(L*h) per kU TP up to 40 g/(L*h) per kU TP, at least 2.0 g/(L*h) per kU TP up to 30 g/(L*h) per kU TP, at least 2.0 g/(L*h) per kU TP up to 25 g/(L*h) per kU TP, at least 2.0 g/(L*h) per kU TP up to 20 g/(L*h) per kU TP, at least 2.0 g/(L*h) per kU TP up to 15 g/(L*h) per kU TP, or at least 2.0 g/(L*h) per kU TP up to 10 g/(L*h) per kU TP.

In another preferred embodiment, the method of the invention is carried out as a two-enzyme process comprising the steps of mixing and reacting, in any order, at least one saccharide raw material, at least one phosphorous source, at least one glucose substrate, at least one alpha-phosphorylase, and at least one trehalose phosphorylase without the addition of a glucose isomerase, wherein the method is characterized by use of an at least one trehalose phosphorylase, wherein the at least one trehalose phosphorylase enables a Productivity per kU of TP enzyme of trehalose from a saccharide raw material of at least 3 g/(L*h) per kU TP to 100 g/(L*h) per kU TP, at least 3.1 g/(L*h) per kU TP up to 100 g/(L*h) per kU TP, at least 3.2 g/(L*h) per kU TP up to 100 g/(L*h) per kU TP, at least 3.3 g/(L*h) per kU TP up to 100 g/(L*h) per kU TP, at least 3.4 g/(L*h) per kU TP up to 100 g/(L*h) per kU TP, at least 3.5 g/(L*h) per kU TP up to 100 g/(L*h) per kU TP, at least 3.6 g/(L*h) per kU TP up to 100 g/(L*h) per kU TP, at least 3.7 g/(L*h) per kU TP up to 100 g/(L*h) per kU TP, at least 3.8 g/(L*h) per kU TP up to 100 g/(L*h) per kU TP, at least 3.9 g/(L*h) per kU TP up to 100 g/(L*h) per kU TP, or at least 4 g/(L*h) per kU TP to 100 g/(L*h) per kU TP, at least 4.1 g/(L'h) per kU TP up to 100 g/(L*h) per kU TP, at least 4.2 g/(L*h) per kU TP up to 100 g/(L*h) per kU TP, at least 4.3 g/(L*h) per kU TP up to 100 g/(L*h) per kU TP, at least 4.4 g/(L*h) per kU TP up to 100 g/(L*h) per kU TP, at least 4.5 g/(L*h) per kU TP up to 100 g/(L*h) per kU TP, at least 4.6 g/(L*h) per kU TP up to 100 g/(L*h) per kU TP, at least 4.7 g/(L*h) per kU TP up to 100 g/(L*h) per kU TP, at least 4.8 g/(L*h) per kU TP up to 100 g/(L*h) per kU TP, at least 4.9 g/(L*h) per kU TP up to 100 g/(L*h) per kU TP, at least 5 g/(L*h) per kU TP up to 100 g/(L'h) per kU TP, or at least 3 g/(L*h) per kU TP up to 90 g/(L*h) per kU TP, at least 3 g/(L*h) per kU TP up to 80 g/(L*h) per kU TP, at least 3 g/(L*h) per kU TP up to 70 g/(L*h) per kU TP, at least 3 g/(L*h) per kU TP up to 60 g/(L*h) per kU TP, at least 3 g/(L*h) per kU TP up to 50 g/(L*h) per kU TP, at least 3 g/(L*h) per kU TP up to 40 g/(L*h) per kU TP, at least 3 g/(L*h) per kU TP up to 30 g/(L*h) per kU TP, or at least 4 g/(L*h) per kU TP up to 90 g/(L*h) per kU TP, at least 4 g/(L*h) per kU TP up to 80 g/(L*h) per kU TP, at least 4 g/(L*h) per kU TP up to 70 g/(L*h) per kU TP, at least 4 g/(L*h) per kU TP up to 60 g/(L*h) per kU TP, at least 4 g/(L*h) per kU TP up to 50 g/(L*h) per kU TP, at least 4 g/(L*h) per kU TP up to 40 g/(L*h) per kU TP, at least 4 g/(L*h) per kU TP up to 30 g/(L*h) per kU TP, or at least 4.8 g/(L*h) per kU TP up to 90 g/(L*h) per kU TP, at least 4.8 g/(L*h) per kU TP up to 80 g/(L*h) per kU TP, at least 4.8 g/(L*h) per kU TP up to 70 g/(L*h) per kU TP, at least 4.8 g/(L*h) per kU TP up to 60 g/(L*h) per kU TP, at least 4.8 g/(L*h) per kU TP up to 50 g/(L*h) per kU TP, at least 4.8 g/(L*h) per kU TP up to 40 g/(L*h) per kU TP, at least 4.8 g/(L*h) per kU TP up to 30 g/(L*h) per kU TP, or at least 4.25 g/(L*h) per kU TP up to 25 g/(L*h) per kU TP, at least 4.5 g/(L*h) per kU TP up to 20 g/(L*h) per kU TP, or at least 4.75 g/(L*h) per kU TP up to 15 g/(L*h) per kU TP. Preferably, the at least one alpha-phosphorylase is a sucrose phosphorylase, and the saccharide raw material is sucrose.

Preferably, the method of the invention is carried out as a two-enzyme process comprising the steps of mixing and reacting, in any order, at least one saccharide raw material, at least one phosphorous source, at least a glucose substrate, at least one alpha-phosphorylase, and at least one trehalose phosphorylase without the addition of a glucose isomerase, wherein the Productivity per kU of TP enzyme of trehalose from a saccharide raw material is at least 3 g/(L*h) per kU TP to 100 g/(L*h) per kU TP, at least 3.1 g/(L*h) per kU TP up to 100 g/(L*h) per kU TP, at least 3.2 g/(L*h) per kU TP up to 100 g/(L*h) per kU TP, at least 3.3 g/(L*h) per kU TP up to 100 g/(L*h) per kU TP, at least 3.4 g/(L*h) per kU TP up to 100 g/(L*h) per kU TP, at least 3.5 g/(L*h) per kU TP up to 100 g/(L*h) per kU TP, at least 3.6 g/(L*h) per kU TP up to 100 g/(L*h) per kU TP, at least 3.7 g/(L*h) per kU TP up to 100 g/(L*h) per kU TP, at least 3.8 g/(L*h) per kU TP up to 100 g/(L*h) per kU TP, at least 3.9 g/(L*h) per kU TP up to 100 g/(L*h) per kU TP, or at least 4 g/(L*h) per kU TP to 100 g/(L*h) per kU TP, at least 4.1 g/(L*h) per kU TP up to 100 g/(L*h) per kU TP, at least 4.2 g/(L*h) per kU TP up to 100 g/(L*h) per kU TP, at least 4.3 g/(L*h) per kU TP up to 100 g/(L*h) per kU TP, at least 4.4 g/(L*h) per kU TP up to 100 g/(L*h) per kU TP, at least 4.5 g/(L*h) per kU TP up to 100 g/(L*h) per kU TP, at least 4.6 g/(L*h) per kU TP up to 100 g/(L*h) per kU TP, at least 4.7 g/(L*h) per kU TP up to 100 g/(L*h) per kU TP, at least 4.8 g/(L*h) per kU TP up to 100 g/(L*h) per kU TP, at least 4.9 g/(L*h) per kU TP up to 100 g/(L*h) per kU TP, at least 5 g/(L*h) per kU TP up to 100 g/(L*h) per kU TP, or at least 3 g/(L*h) per kU TP up to 90 g/(L*h) per kU TP, at least 3 g/(L*h) per kU TP up to 80 g/(L*h) per kU TP, at least 3 g/(L*h) per kU TP up to 70 g/(L*h) per kU TP, at least 3 g/(L*h) per kU TP up to 60 g/(L*h) per kU TP, at least 3 g/(L*h) per kU TP up to 50 g/(L*h) per kU TP, at least 3 g/(L*h) per kU TP up to 40 g/(L*h) per kU TP, at least 3 g/(L*h) per KU TP up to 30 g/(L*h) per kU TP, or at least 4 g/(L*h) per kU TP up to 90 g/(L*h) per kU TP, at least 4 g/(L*h) per kU TP up to 80 g/(L*h) per kU TP, at least 4 g/(L*h) per kU TP up to 70 g/(L*h) per kU TP, at least 4 g/(L*h) per kU TP up to 60 g/(L*h) per kU TP, at least 4 g/(L*h) per kU TP up to 50 g/(L*h) per kU TP, at least 4 g/(L*h) per kU TP up to 40 g/(L*h) per kU TP, at least 4 g/(L*h) per kU TP up to 30 g/(L*h) per kU TP, or at least 4.8 g/(L*h) per kU TP up to 90 g/(L*h) per kU TP, at least 4.8 g/(L*h) per kU TP up to 80 g/(L*h) per kU TP, at least 4.8 g/(L*h) per kU TP up to 70 g/(L*h) per kU TP, at least 4.8 g/(L*h) per kU TP up to 60 g/(L*h) per kU TP, at least 4.8 g/(L*h) per kU TP up to 50 g/(L*h) per kU TP, at least 4.8 g/(L*h) per kU TP up to 40 g/(L*h) per kU TP, at least 4.8 g/(L*h) per kU TP up to 30 g/(L*h) per kU TP, or at least 4.25 g/(L*h) per kU TP up to 25 g/(L*h) per kU TP, at least 4.5 g/(L*h) per kU TP up to 20 g/(L*h) per kU TP, or at least 4.75 g/(L*h) per kU TP up to 15 g/(L*h) per kU TP. Preferably, the at least one alpha-phosphorylase is a sucrose phosphorylase, and the saccharide raw material is sucrose.

Preferably, the at least one trehalose phosphorylase providing the Productivity per kU TP enzyme is a trehalose phosphorylase variant according to any one of the aspects and/or embodiments described herein.

In the context of this invention, it is to be understood that the term "Productivity per kU TP enzyme" means the space-time-yield (i.e. the amount of trehalose product obtained per reaction volume and per time) which is produced per kU (kilo-unit, 1,000 Units) of trehalose phosphorylase enzyme activity subjected to the reaction during the reaction time. Trehalose phosphorylase activity is determined by standard enzymatic assays known in the art, such as for example, by using the TP Assay I as outlined in the example section of the present invention. The Productivity per kU trehalose phosphorylase according to the method of the invention is or may be determined at any time during the enzymatic conversion until up to the time of completion of the reaction, where no more trehalose product is formed by enzymatic conversion.

Preferably, the Productivity per kU of TP enzyme is reached by carrying out the method at a reaction temperature of at least 20° C. up to 80° C., preferably of at least 30° C. up to 80° C., more preferably of at least 39° C. up to 80° C., more preferably of at least 40° C. up to 80° C., more preferably of at least 39° C. up to 60° C., even more preferably of at least 40° C. up to 60° C., and most preferably of at least 45° C. up to 60° C.

Even more preferably, the Productivity per kU of TP enzyme is reached by carrying out the method at a reaction temperature of at least 20° C. up to 80° C., 21° C. up to 80° C., 22° C. up to 80° C., 23° C. up to 80° C., 24° C. up to 80° C., 25° C. up to 80° C., 26° C. up to 80° C., 27° C. up to 80° C., 28° C. up to 80° C., 29° C. up to 80° C., preferably of at least 30° C. up to 80° C., 31° C. up to 80° C., 32° C. up to 80° C., 33° C. up to 80° C., 34° C. up to 80° C., 35° C. up to 80° C., 36° C. up to 80° C., 37° C. up to 80° C., 38° C. up to 80° C., 39° C. up to 80° C., more preferably of at least 40° C. up to 80° C., 41° C. up to 80° C., 42° C. up to 80° C., 43° C. up to 80° C., 44° C. up to 80° C., 45° C. up to 80° C., 46° C. up to 80° C., 47° C. up to 80° C., 48° C. up to 80° C., 49° C. up to 80° C., even more preferably of at least 39° C. up to 60° C., 40° C. up to 60° C., 41° C. up to 60° C., 42° C. up to 60° C. 43° C. up to 60° C. 44° C. up to 60° C. 45° C. up to 60° C., 46° C. up to 60° C., 47° C. up to 60° C., 48° C. up to 60° C., 49° C. up to 60° C., and most preferably of at least 45° C. up to 60° C.

In a preferred embodiment, the method of the invention is carried out at a reaction temperature of at least 30° C. to 70° C. preferably at 39° C. to 60° C. more preferably at 40° C. to 60° C. in a three-enzyme process comprising the steps of mixing and reacting, in any order, at least one saccharide raw material, at least one phosphorous source, at least one alpha-phosphorylase, preferably a sucrose phosphorylase, at least one glucose isomerase and at least one trehalose phosphorylase, wherein the method is characterized by the use of an at least one trehalose phosphorylase, wherein the at least one trehalose phosphorylase enables a Productivity per kU of TP enzyme of trehalose from the saccharide raw material sucrose of at least 1.0 g/(L*h) per kU TP to 100 g/(L*h) per kU TP, at least 1.1 g/(L*h) per kU TP to 100 g/(L*h) per kU TP, at least 1.2 g/(L*h) per kU TP to 100 g/(L*h) per kU TP, at least 1.3 g/(L*h) per kU TP to 100 g/(L*h) per kU TP, at least 1.4 g/(L*h) per kU TP to 100 g/(L*h) per kU TP, at least 1.5 g/(L*h) per kU TP to 100 g/(L*h) per kU TP, preferably at least 1.6 g/(L*h) per kU TP up to 100 g/(L*h) per kU TP, at least 1.7 g/(L*h) per kU TP up to 100 g/(L*h) per kU TP, even more preferably at least 1.8 g/(L*h) per kU TP up to 100 g/(L*h) per kU TP, at least 1.9 g/(L*h) per kU TP up to 100 g/(L*h) per kU TP, at least 2 g/(L*h) per kU TP up to 100 g/(L*h) per kU TP, at least 2.1 g/(L*h) per kU TP up to 100 g/(L*h) per kU TP, at least 2.2 g/(L*h) per kU TP up to 100 g/(L*h) per kU TP, at least 2.3 g/(L*h) per kU TP up to 100 g/(L*h) per kU TP, at least 2.4 g/(L*h) per kU TP up to 100 g/(L*h) per kU TP, at least 2.5 g/(L*h) per kU TP up to 100 g/(L*h) per kU TP, or at least 1.0 g/(L*h) per kU TP up to 90 g/(L*h) per kU TP, at least 1.0 g/(L*h) per kU TP up to 80 g/(L*h) per kU TP, at least 1.0 g/(L*h) per kU TP up to 70 g/(L*h) per kU TP, at least 1.0 g/(L*h) per kU TP up to 60 g/(L*h) per kU TP, at least 1.0 g/(L*h) per kU TP up to 50 g/(L*h) per kU TP, at least 1.0 g/(L*h) per kU TP up to 40 g/(L*h) per kU TP, at least 1.0 g/(L*h) per kU TP up to 30 g/(L*h) per kU TP, at least 1.0 g/(L*h) per kU TP up to 25 g/(L*h) per kU TP, at least 1.0 g/(L*h) per kU TP up to 20 g/(L*h) per kU TP, at least 1.0 g/(L*h) per kU TP up to 15 g/(L*h) per kU TP, at least 1.0 g/(L*h) per kU TP up to 10 g/(L*h) per kU TP, or at least 1.6 g/(L*h) per kU TP up to 90 g/(L*h) per kU TP, at least 1.6 g/(L*h) per kU TP up to 80 g/(L*h) per kU TP, at least 1.6 g/(L*h) per kU TP up to 70 g/(L*h) per kU TP,
at least 1.6 g/(L*h) per kU TP up to 60 g/(L*h) per kU TP,
at least 1.6 g/(L*h) per kU TP up to 50 g/(L*h) per kU TP,
at least 1.6 g/(L*h) per kU TP up to 40 g/(L*h) per kU TP,
at least 1.6 g/(L*h) per kU TP up to 30 g/(L*h) per kU TP,
at least 1.6 g/(L*h) per kU TP up to 25 g/(L*h) per kU TP,
at least 1.6 g/(L*h) per kU TP up to 20 g/(L*h) per kU TP,
at least 1.6 g/(L*h) per kU TP up to 15 g/(L*h) per kU TP,
at least 1.6 g/(L*h) per kU TP up to 10 g/(L*h) per kU TP,
or at least 1.8 g/(L*h) per kU TP up to 90 g/(L*h) per kU TP,
at least 1.8 g/(L*h) per kU TP up to 80 g/(L*h) per kU TP,
at least 1.8 g/(L*h) per kU TP up to 70 g/(L*h) per kU TP,
at least 1.8 g/(L*h) per kU TP up to 60 g/(L*h) per kU TP,
at least 1.8 g/(L*h) per kU TP up to 50 g/(L*h) per kU TP,
at least 1.8 g/(L*h) per kU TP up to 40 g/(L*h) per kU TP,
at least 1.8 g/(L*h) per kU TP up to 30 g/(L*h) per kU TP,
at least 1.8 g/(L*h) per kU TP up to 25 g/(L*h) per kU TP,
at least 1.8 g/(L*h) per kU TP up to 20 g/(L*h) per kU TP,
at least 1.8 g/(L*h) per kU TP up to 15 g/(L*h) per kU TP,
at least 1.8 g/(L*h) per kU TP up to 10 g/(L*h) per kU TP,
or at least 2.0 g/(L*h) per kU TP up to 90 g/(L*h) per kU TP,
at least 2.0 g/(L*h) per kU TP up to 80 g/(L*h) per kU TP,
at least 2.0 g/(L*h) per kU TP up to 70 g/(L*h) per kU TP,
at least 2.0 g/(L*h) per kU TP up to 60 g/(L*h) per kU TP,
at least 2.0 g/(L*h) per kU TP up to 50 g/(L*h) per kU TP,
at least 2.0 g/(L*h) per kU TP up to 40 g/(L*h) per kU TP,
at least 2.0 g/(L*h) per kU TP up to 30 g/(L*h) per kU TP,
at least 2.0 g/(L*h) per kU TP up to 25 g/(L*h) per kU TP,
at least 2.0 g/(L*h) per kU TP up to 20 g/(L*h) per kU TP,
at least 2.0 g/(L*h) per kU TP up to 15 g/(L*h) per kU TP,
or at least 2.0 g/(L*h) per kU TP up to 10 g/(L*h) per kU TP.

Preferably, the method of the invention is carried out at a temperature of at least 30° C. to 70° C., preferably at 39° C. to 60° C., more preferably at 40° C. to 60° C. in a three-enzyme process comprising the steps of mixing and reacting, in any order, at least one saccharide raw material, at least one phosphorous source, at least one alpha-phosphorylase, preferably a sucrose phosphorylase, at least one glucose isomerase and at least one trehalose phosphorylase, wherein the Productivity per kU of TP enzyme of trehalose from the saccharide raw material sucrose is at least 1.0 g/(L*h) per kU TP to 100 g/(L*h) per kU TP, at least 1.1 g/(L*h) per kU TP to 100 g/(L'h) per kU TP, at least 1.2 g/(L*h) per kU TP to 100 g/(L*h) per kU TP, at least 1.3 g/(L*h) per kU TP to 100 g/(L*h) per kU TP, at least 1.4 g/(L*h) per kU TP to 100 g/(L*h) per kU TP, at least 1.5 g/(L*h) per kU TP to 100 g/(L*h) per kU TP, preferably at least 1.6 g/(L*h) per kU TP up to 100 g/(L*h) per kU TP, at least 1.7 g/(L*h) per kU TP up to 100 g/(L*h) per kU TP, even more preferably at least 1.8 g/(L*h) per kU TP up to 100 g/(L*h) per kU TP, at least 1.9 g/(L*h) per kU TP up to 100 g/(L*h) per kU TP, at least 2 g/(L*h) per kU TP up to 100 g/(L*h) per kU TP, at least 2.1 g/(L*h) per kU TP up to 100 g/(L*h) per kU TP, at least 2.2 g/(L*h) per kU TP up to 100 g/(L*h) per kU TP, at least 2.3 g/(L*h) per kU TP up to 100 g/(L*h) per kU TP, at least 2.4 g/(L*h) per kU TP up to 100 g/(L*h) per kU TP, at least 2.5 g/(L*h) per kU TP up to 100 g/(L*h) per kU TP, or at least 1.0 g/(L*h) per kU TP up to 90 g/(L*h) per kU TP, at least 1.0 g/(L*h) per kU TP up to 80 g/(L*h) per kU TP, at least 1.0 g/(L*h) per kU TP up to 70 g/(L*h) per kU TP, at least 1.0 g/(L*h) per kU TP up to 60 g/(L*h) per kU TP, at least 1.0 g/(L*h) per kU TP up to 50 g/(L*h) per kU TP, at least 1.0 g/(L*h) per kU TP up to 40 g/(L*h) per kU TP, at least 1.0 g/(L*h) per kU TP up to 30 g/(L*h) per kU TP, at least 1.0 g/(L*h) per kU TP up to 25 g/(L*h) per kU TP, at least 1.0 g/(L*h) per kU TP up to 20 g/(L*h) per kU TP, at least 1.0 g/(L*h) per kU TP up to 15 g/(L*h) per kU TP, at least 1.0 g/(L*h) per kU TP up to 10 g/(L*h) per kU TP, or at least 1.6 g/(L*h) per kU TP up to 90 g/(L*h) per kU TP, at least 1.6 g/(L*h) per kU TP up to 80 g/(L*h) per kU TP, at least 1.6 g/(L*h) per kU TP up to 70 g/(L*h) per kU TP, at least 1.6 g/(L*h) per kU TP up to 60 g/(L*h) per kU TP, at least 1.6 g/(L*h) per kU TP up to 50 g/(L*h) per kU TP, at least 1.6 g/(L*h) per kU TP up to 40 g/(L*h) per kU TP, at least 1.6 g/(L*h) per kU TP up to 30 g/(L*h) per kU TP, at least 1.6 g/(L*h) per kU TP up to 25 g/(L*h) per kU TP, at least 1.6 g/(L*h) per kU TP up to 20 g/(L*h) per kU TP, at least 1.6 g/(L*h) per kU TP up to 15 g/(L*h) per kU TP, at least 1.6 g/(L*h) per kU TP up to 10 g/(L*h) per kU TP, or at least 1.8 g/(L*h) per kU TP up to 90 g/(L*h) per kU TP, at least 1.8 g/(L*h) per kU TP up to 80 g/(L*h) per kU TP, at least 1.8 g/(L*h) per kU TP up to 70 g/(L*h) per kU TP, at least 1.8 g/(L*h) per kU TP up to 60 g/(L*h) per kU TP, at least 1.8 g/(L*h) per kU TP up to 50 g/(L*h) per kU TP, at least 1.8 g/(L*h) per kU TP up to 40 g/(L*h) per kU TP, at least 1.8 g/(L*h) per kU TP up to 30 g/(L*h) per kU TP, at least 1.8 g/(L*h) per kU TP up to 25 g/(L*h) per kU TP, at least 1.8 g/(L*h) per kU TP up to 20 g/(L*h) per kU TP, at least 1.8 g/(L*h) per kU TP up to 15 g/(L*h) per kU TP, at least 1.8 g/(L*h) per kU TP up to 10 g/(L*h) per kU TP, or at least 2.0 g/(L*h) per kU TP up to 90 g/(L*h) per kU TP, at least 2.0 g/(L*h) per kU TP up to 80 g/(L*h) per KU TP, at least 2.0 g/(L*h) per kU TP up to 70 g/(L*h) per kU TP, at least 2.0 g/(L*h) per kU TP up to 60 g/(L*h) per kU TP, at least 2.0 g/(L*h) per kU TP up to 50 g/(L*h) per kU TP, at least 2.0 g/(L*h) per kU TP up to 40 g/(L*h) per kU TP, at least 2.0 g/(L*h) per kU TP up to 30 g/(L*h) per kU TP, at least 2.0 g/(L*h) per kU TP up to 25 gall) per kU TP, at least 2.0 g/(L*h) per kU TP up to 20 g/(L*h) per kU TP, at least 2.0 g/(L*h) per kU TP up to 15 g/(L*h) per kU TP, or at least 2.0 g/(L*h) per kU TP up to 10 g/(L*h) per kU TP.

In an equally preferred embodiment, the method of the invention is carried out at a temperature of at least 30° C. to 70° C., preferably at 39° C. to 60° C. more preferably at 40° C. to 60° C. in a two-enzyme process comprising the steps of mixing and reacting, in any order, at least one saccharide raw material, at least one phosphorous source, at least a glucose substrate, at least one alpha-phosphorylase, and at least one trehalose phosphorylase without the addition of a glucose isomerase, wherein the method is characterized by use of an at least one trehalose phosphorylase, wherein the at least one trehalose phosphorylase enables a Productivity per kU of TP enzyme of trehalose from saccharide raw material of at least 3 g/(L*h) per kU TP to 100 g/(L*h) per kU TP, at least 3.1 g/(L*h) per kU TP up to 100 g/(L*h) per kU TP, at least 3.2 g/(L*h) per kU TP up to 100 g/(L*h) per kU TP, at least 3.3 g/(L*h) per kU TP up to 100 g/(L*h) per kU TP, at least 3.4 g/(L*h) per kU TP up to 100 g/(L*h) per kU TP, at least 3.5 g/(L*h) per kU TP up to 100 g/(L*h) per kU TP, at least 3.6 g/(L*h) per kU TP up to 100 g/(L*h) per kU TP, at least 3.7 g/(L*h) per kU TP up to 100 g/(L*h) per kU TP, at least 3.8 g/(L*h) per kU TP up to 100 g/(L*h) per kU TP, at least 3.9 g/(L*h) per kU TP up to 100 g/(L*h) per kU TP, or at least 4 g/(L*h) per kU TP to 100 g/(L*h) per kU TP, at least 4.1 g/(L*h) per kU TP up to 100 g/(L*h) per KU TP, at least 4.2 g/(L*h) per kU TP up to 100 g/(L*h) per kU TP, at least 4.3 g/(L*h) per kU TP up to 100 g/(L*h) per kU TP, at least 4.4 g/(L*h) per kU TP up to 100 g/(L*h) per kU TP, at least 4.5 g/(L*h) per kU TP up to 100 g/(L*h) per kU TP, at least 4.6 g/(L*h) per kU TP up to 100 g/(L*h) per kU TP, at least 4.7 g/(L*h) per kU TP up to 100 g/(L*h) per kU TP, at least 4.8 g/(L*h) per kU TP up to 100 g/(L*h) per kU TP, at least 4.9 g/(L*h) per kU TP up to 100 g/(L*h) per kU TP, at least 5 g/(L*h) per kU TP up to 100 g/(L*h) per kU TP, or at least 3 g/(L*h) per KU TP up to 90 g/(L*h) per kU TP, at least 3 g/(L*h) per kU TP up to 80 g/(L*h) per kU TP, at least 3 g/(L*h) per KU TP up to 70 g/(L*h) per kU TP, at least 3 g/(L*h) per kU TP up to 60 g/(L*h) per kU TP, at least 3 g/(L*h) per kU TP up to 50 g/(L*h) per kU TP, at least 3 g/(L*h) per kU TP up to 40 g/(L*h) per kU TP, at least 3 g/(L*h) per kU TP up to 30 g/(L*h) per kU TP, or at least 4 g/(L*h) per kU TP up to 90 g/(L*h) per kU IF, at least 4 g/(L*h) per kU TP up to 80 g/(L*h) per kU TP, at least 4 g/(L*h) per kU TP up to 70 g/(L*h) per kU TP, at least 4 g/(L*h) per kU TP up to 60 g/(L*h) per KU TP, at least 4 g/(L*h) per kU TP up to 50 g/(L*h) per kU TP, at least 4 g/(L*h) per kU TP up to 40 g/(L*h) per kU TP, at least 4 g/(L*h) per kU TP up to 30 g/(L*h) per kU TP, or at least 4.8 g/(L*h) per kU TP up to 90 g/(L*h) per kU TP, at least 4.8 g/(L*h) per kU TP up to 80 g/(L*h) per kU TP, at least 4.8 g/(L*h) per kU TP up to 70 g/(L*h) per kU TP, at least 4.8 g/(L*h) per kU TP up to 60 g/(L*h) per kU TP, at least 4.8 g/(L*h) per KU TP up to 50 g/(L*h) per kU TP, at least 4.8 g/(L*h) per KU TP up to 40 g/(L*h) per kU TP, at least 4.8 g/(L*h) per kU TP up to 30 g/(L*h) per kU TP, or at least 4.25 g/(L*h) per kU TP up to 25 g/(L*h) per kU TP, at least 4.5 g/(L*h) per kU TP up to 20 g/(L*h) per kU TP, or at least 4.75 g/(L*h) per kU TP up to 15 g/(L*h) per kU TP. Preferably, the at least one alpha-phosphorylase is a sucrose phosphorylase, and preferably the saccharide raw material is sucrose.

Preferably, the method of the invention is carried out at a temperature of at least 30° C. to 70° C., preferably at 39° C. to 60° C., more preferably at 40° C. to 60° C. in a two-enzyme process comprising the steps of mixing and reacting, in any order, at least one saccharide raw material, at least one phosphorous source, at least a glucose substrate, at least one alpha-phosphorylase, and at least one trehalose phosphorylase without the addition of a glucose isomerase, wherein the Productivity per kU of TP enzyme of trehalose from saccharide raw material is at least 3 g/(L*h) per kU TP to 100 g/(L*h) per kU TP, at least 3.1 g/(L*h) per kU TP up to 100 g/(L*h) per kU TP, at least 3.2 g/(L*h) per kU TP up to 100 g/(L*h) per kU TP, at least 3.3 g/(L*h) per kU TP up to 100 g/(L*h) per kU TP, at least 3.4 g/(L*h) per kU TP up to 100 g/(L*h) per kU TP, at least 3.5 g/(L*h) per kU TP up to 100 g/(L*h) per kU TP, at least 3.6 g/(L*h) per kU TP up to 100 g/(L*h) per kU TP, at least 3.7 g/(L*h) per kU TP up to 100 g/(L*h) per kU TP, at least 3.8 g/(L*h) per kU TP up to 100 g/(L*h) per kU TP, at least 3.9 g/(L*h) per kU TP up to 100 g/(L*h) per kU TP, or at least 4 g/(L*h) per kU TP to 100 g/(L*h) per kU TP, at least 4.1 g/(L*h) per kU TP up to 100 g/(L*h) per kU TP, at least 4.2 g/(L*h) per kU TP up to 100 g/(L*h) per kU TP, at least 4.3 gat) per kU TP up to 100 g/(L*h) per kU TP, at least 4.4 g/(L*h) per kU TP up to 100 g/(L*h) per kU TP, at least 4.5 g/(L*h) per kU TP up to 100 g/(L*h) per kU TP, at least 4.6 g/(L*h) per kU TP up to 100 g/(L*h) per kU TP, at least 4.7 g/(L*h) per kU TP up to 100 g/(L*h) per kU TP, at least 4.8 g/(L*h) per kU TP up to 100 g/(L*h) per kU TP, at least 4.9 g/(L*h) per kU TP up to 100 g/(L*h) per kU TP, at least 5 g/(L*h) per kU TP up to 100 g/(L*h) per kU TP, or at least 3 g/(L*h) per kU TP up to 90 g/(L*h) per kU TP, at least 3 g/(L*h) per kU TP up to 80 g/(L*h) per kU TP, at least 3 g/(L*h) per kU TP up to 70 g/(L*h) per kU TP, at least 3 g/(L*h) per kU TP up to 60 g/(L*h) per kU TP, at least 3 g/(L*h) per kU TP up to 50 g/(L*h) per kU TP, at least 3 g/(L*h) per kU TP up to 40 g/(L*h) per kU TP, at least 3 g/(L*h) per kU TP up to 30 g/(L*h) per kU TP, or at least 4 g/(L*h) per kU TP up to 90 g/(L*h) per kU TP, at least 4 g/(L*h) per kU TP up to 80 g/(L*h) per kU TP, at least 4 g/(L*h) per kU TP up to 70 g/(L*h) per kU TP, at least 4 g/(L*h) per kU TP up to 60 g/(L*h) per kU TP, at least 4 g/(L*h) per kU TP up to 50 g/(L*h) per kU TP, at least 4 g/(L*h) per kU TP up to 40 g/(L*h) per kU TP, at least 4 g/(L*h) per kU TP up to 30 g/(L*h) per kU TP, or at least 4.8 g/(L*h) per kU TP up to 90 g/(L*h) per kU TP, at least 4.8 g/(L*h) per kU TP up to 80 g/(L*h) per kU TP, at least 4.8 g/(L*h) per kU TP up to 70 g/(L*h) per kU TP, at least 4.8 g/(L*h) per kU TP up to 60 g/(L*h) per kU TP, at least 4.8 g/(L*h) per kU TP up to 50 g/(L*h) per kU TP, at least 4.8 g/(L*h) per kU TP up to 40 g/(L*h) per kU TP, at least 4.8 g/(L*h) per kU TP up to 30 g/(L*h) per kU TP, or at least 4.25 g/(L*h) per kU TP up to 25 g/(L*h) per kU TP, at least 4.5 g/(L*h) per kU TP up to 20 g/(L*h) per kU TP, or at least 4.75 g/(L*h) per kU TP up to 15 g/(L*h) per kU TP. Preferably, the at least one alpha-phosphorylase is a sucrose phosphorylase, and preferably the saccharide raw material is sucrose.

Preferably, the at least one trehalose phosphorylase providing the Productivity per kU TP enzyme at a certain temperature is a trehalose phosphorylase variant according to any one of the aspects and/or embodiments described herein.

In another preferred embodiment of the first aspect, which is also a preferred embodiment of all previous embodiments relating thereto, the at least one trehalose phosphorylase is derived from an organism belonging to the phylum of Basidomycota, preferably from an organism belonging to the class of Agaricomycetes, more preferably from an organism belonging to a genus of the group consisting of the genera *Schizophyllum, Pleurotus, Grifola, Agaricus, Trametes, Coriolus, Trametes, Trichaptum*, and *Lenzites*, even more preferably derived from the genera *Schizophyllum* and *Grifola*, and most preferably derived from the organism *Schizophyllum commune* or *Grifola frondosa*.

In a preferred embodiment of the first aspect, which is also a preferred embodiment of all embodiments related thereto, the at least one trehalose phosphorylase is characterized by one or more of the characteristics selected from the group consisting of the characteristics (A), (B), (C), and (D), wherein the characteristics are defined as (A) a thermal stability, wherein the thermal stability is characterized by a residual enzymatic activity of from 30% to 100% after incubation of the enzyme at 52° C. for 15 minutes, preferably in the presence of 1M sucrose.

In this context, the characteristic (A) is preferably a thermal stability after incubation at 52° C. for 15 minutes, preferably in the presence of 1M sucrose, and as defined by a residual enzymatic activity of 30% to 90%, preferably from 38% to 90%, preferably from 39% to 90%, more preferably from 42% to 90%, more preferably from 54% to 90%, more preferably from 55% to 90%, even more preferably from 63% to 90%, even more preferably from 64% to 90%, even more preferably from 65% to 90%, even more preferably from 68% to 90%, and most preferably from 64% to 86%; and/or from 30% to 90%, preferably from 31% to 90%, preferably from 32% to 90%, preferably from 33% to 90%, preferably from 34% to 90%, preferably from 35% to 90%, preferably from 36% to 90%, preferably from 37% to 90%, preferably from 38% to 90%, preferably from 39% to 90%, more preferably from 40% to 90%, more preferably from 41% to 90%, more preferably from 42% to 90%, more preferably from 43% to 90%, more preferably from 44% to 90% more preferably from 45% to 90%, more preferably from 46% to 90%, more preferably from 47% to 90%, more preferably from 48% to 90%, more preferably from 49% to 90%, even more preferably from 50% to 90%, even more preferably from 51% to 90%, even more preferably from 52% to 90%, even more preferably from 53% to 90%, even more preferably from 54% to 90%, even more preferably from 55% to 90%, even more preferably from 60% to 90%, even more preferably from 61% to 90%, even more preferably from 65% to 90%, even more preferably from 70% to 90%, even more preferably from 75% to 90%, and most preferably from 72% to 81%, and/or from 38% to 100%, preferably from 55% to 100%, preferably from 60% to 100%, preferably from 70% to 100%, preferably from 75% to 100%, preferably from 76% to 100%, preferably from 77% to 100%, preferably from 78% to 100%, preferably from 79% to 100%, more preferably from 80% to 100%, more preferably from 81% to 100%, more preferably from 82% to 100%, more preferably from 83% to 100%, more preferably from 84% to 100%, more preferably from 85% to 100%, more preferably from 86% to 100%, more preferably from 87% to 100%, more preferably from 88% to 100%, more preferably from 89% to 100%, even more preferably from 90% to 100%, even more preferably from 91% to 100%, even more preferably from 92% to 100%, even more preferably from 93% to 100%, even more preferably from 94% to 100%, even more preferably from 95% to 100%, even more preferably from 96% to 100%, even more preferably from 97% to 100%, even more preferably from 98% to 100%, even more preferably from 99% to 100%, and most preferably 100%.

(B) a thermal stability, wherein the thermal stability is characterized by a Tm50-value of at least 52° C. after incubation of the enzyme at 52° C. for 15 minutes, preferably in the presence of 1M sucrose;

(C) a thermal stability, wherein the thermal stability is characterized by a Tm50-value of between 52° C. and 90° C. after incubating the enzyme at 52° C. to 90° C. for 15 minutes, preferably in the presence of 1M sucrose.

In this context, the characteristic (C) is preferably a thermal stability after incubation at 52° C. for 15 minutes, preferably in the presence of 1 M sucrose, which is characterized by a Tm50-value between 52° C. and 90° C., preferably between 52° C. and 80° C., preferably between 52.5° C. and 80° C., preferably between 53° C. and 80° C., preferably between 53.5° C. and 80° C., more preferably between 54° C. and 80° C., preferably between 54.5° C. and 80° C., even more preferably between 55° C. and 80° C., preferably between 55.5° C. and 80° C., preferably between 56° C. and 80° C., preferably between 56.5° C. and 80° C., preferably between 57° C. and 80° C., preferably between 57.5° C. and 80° C., even more preferably between 52° C. and 70° C., even more preferably between 52.5° C. and 70° C., even more preferably between 53° C. and 70° C., even more preferably between 53.5° C. and 70° C., more even more preferably between 54° C. and 70° C., even more preferably between 5.4.5° C. and 70° C., even more even more preferably between 55° C. and 70° C., even more preferably between 55.5° C. and 70° C., even more preferably between 56° C. and 70° C., even more preferably between 56.5° C. and 70° C., even more preferably between 57° C. and 70° C., even more preferably between 57.5° C. and 70° C., even more preferably between 52° C. and 65° C., even more preferably between 52.5° C. and 65° C., even more preferably between 53° C. and 65° C., even more preferably between 53.5° C. and 65° C., even more preferably between 54° C. and 65° C., even more preferably between 54.5° C. and 65° C., even more even more preferably between 55° C. and 65° C., even more preferably between 55.5° C. and 65° C., even more preferably between 56° C. and 65° C., even more preferably between 56.5° C. and 65° C., even more preferably between 57° C. and 65° C., even more preferably between 57.5° C. and 65° C., even more preferably between 52° C. and 60° C., even more preferably between 52.5° C. and 60° C., even more preferably between 53° C. and 60° C., even more preferably between 53.5° C. and 60° C., more even more preferably between 54° C. and 60° C. even more preferably between 54.5° C. and 60° C., even more even more preferably between 55° C. and 60° C., even more preferably between 55.5° C. and 60° C., even more preferably between 56° C. and 60° C., even more preferably between 56.5° C. and 60° C., even more preferably between 57° C. and 60° C., even more preferably between 57.5° C. and 60° C., and most preferably between 52° C. and 57.5° C.

(D) a thermal stability, wherein the thermal stability is in form of a process stability characterized by an half-life of from 3 hours to 9 days or more, preferably by a half-life of from 24 hours to 9 days or more, more preferably by a half-life of 4 days to 9 days or more, preferably in the presence of 1M sucrose.

Preferably, the characteristic (D) is a thermal stability characterized by a process stability, characterized by a half-life at 45° C. of from 3 hours to 9 days or more, preferably of from 24 hours to 9 days or more, preferably of from 39 hours to 9 days or more, preferably of from 2 days to 9 days or more, more preferably of from 4 days to 9 days or more, more preferably of from 5.5 days to 9 days or more, more preferably of from least 7 days to 9 days or more, even more preferably of at least 9 days or more, and most preferably of 9 days; and/or a process stability, characterized by a half-life at 45° C. of from 24 hours to 9 days or more, more preferably of from 39 hours to 9 days or more, more preferably of from 2 days to 9 days or more, more preferably of from 4 days to 9 days or more, more preferably of from 5.5 days to 9 days or more, more preferably of from 7 days to 9 days or more, even more preferably of at least 9 days or more, and most preferably of 9 days; and/or a process stability, characterized by a half-life at 45° C. of 4 days to 9 days or more, preferably of from 5.5 days up to 9 days or more, more preferably of from 7 days up to 9 days or more, even more preferably of at least 9 days or more, and most preferably of 9 days.

Preferably, the at least one trehalose phosphorylase characterized by one or more of the characteristics selected from the group consisting of the characteristics (A), (B), (C), and (D) is a trehalose phosphorylase variant according to any one of the aspects and/or embodiments described herein.

In an preferred embodiment of any one of the aspects and embodiments described herein, the at least one trehalose phosphorylase is characterized by one or more of the characteristics selected from the group consisting of the characteristics (A), (B), (C), and (D), and enables the performance of a three-enzyme process comprising the steps of mixing and reacting, in any order, at least one saccharide raw material, at least one phosphorous source, at least one alpha-phosphorylase, preferably a sucrose phosphorylase, at least one glucose isomerase and at least one trehalose phosphorylase, wherein the Productivity per kU of TP enzyme of trehalose from sucrose is at least 1.0 g/(L*h) per kU TP to 100 g/(L*h) per kU TP, at least 1.1 g/(L*h) per kU TP to 100 g/(L*h) per kU TP, at least 1.2 g/(L*h) per kU TP to 100 g/(L*h) per kU TP, at least 1.3 g/(L*h) per kU TP to 100 g/(L*h) per kU TP, at least 1.4 g/(L*h) per kU TP to 100 g/(L*h) per kU TP, at least 1.5 g/(L*h) per kU TP to 100 g/(L*h) per kU TP, preferably at least 1.6 g/(L*h) per kU TP up to 100 g/(L*h) per kU TP, at least 1.7 g/(L*h) per kU TP up to 100 g/(L*h) per kU TP, even more preferably at least 1.8 g/(L*h) per kU TP up to 100 g/(L*h) per kU TP, at least 1.9 g/(L*h) per kU TP up to 100 g/(L*h) per kU TP, at least 2 g/(L*h) per kU TP up to 100 g/(L*h) per kU TP, at least 2.1 g/(L*h) per kU TP up to 100 g/(L*h) per kU TP, at least 2.2 g/(L*h) per kU TP up to 100 g/(L*h) per kU TP, at least 2.3 g/(L*h) per kU TP up to 100 g/(L*h) per kU TP, at least 2.4 g/(L*h) per kU TP up to 100 g/(L*h) per kU TP, at least 2.5 g/(L*h) per kU TP up to 100 g/(L*h) per kU TP, or at least 1.0 g/(L*h) per kU TP up to 90 g/(L*h) per kU TP, at least 1.0 g/(L*h) per kU TP up to 80 g/(L*h) per kU TP, at least 1.0 g/(L*h) per kU TP up to 70 g/(L*h) per kU TP, at least 1.0 g/(L*h) per kU TP up to 60 g/(L*h) per kU TP, at least 1.0 g/(L*h) per kU TP up to 50 g/(L*h) per kU TP, at least 1.0 g/(L*h) per kU TP up to 40 g/(L*h) per kU TP, at least 1.0 g/(L*h) per kU TP up to 30 g/(L*h) per kU TP, at least 1.0 g/(L*h) per kU TP up to 25 g/(L*h) per kU TP, at least 1.0 g/(L*h) per kU TP up to 20 g/(L*h) per kU TP, at least 1.0 g/(L*h) per kU TP up to 15 g/(L*h) per kU TP, at least 1.0 g/(L*h) per kU TP up to 10 g/(L*h) per kU TP, or at least 1.6 g/(L*h) per kU TP up to 90 g/(L*h) per kU TP, at least 1.6 g/(L*h) per kU TP up to 80 g/(L*h) per kU TP, at least 1.6 g/(L*h) per kU TP up to 70 g/(L*h) per kU TP, at least 1.6 g/(L*h) per kU TP up to 60 g/(L*h) per kU TP, at least 1.6 g/(L*h) per kU TP up to 50 g/(L*h) per kU TP, at least 1.6 g/(L*h) per kU TP up to 40 g/(L*h) per kU TP, at least 1.6 g/(L*h) per kU TP up to 30 g/(L*h) per kU TP, at least 1.6 g/(L*h) per kU TP up to 25 g/(L*h) per kU TP, at least 1.6 g/(L*h) per kU TP up to 20 g/(L*h) per kU TP, at least 1.6 g/(L*h) per kU TP up to 15 g/(L*h) per kU TP, at least 1.6 g/(L*h) per kU TP up to 10 g/(L*h) per kU TP, or at least 1.8 g/(L*h) per kU TP up to 90 g/(L*h) per kU TP, at least 1.8 g/(L*h) per kU TP up to 80 g/(L*h) per kU TP, at least 1.8 g/(L*h) per kU TP up to 70 g/(L*h) per kU TP, at least 1.8 g/(L*h) per kU TP up to 60 g/(L*h) per kU TP, at least 1.8 g/(L*h) per kU TP up to 50 g/(L*h) per kU TP, at least 1.8 g/(L*h) per kU TP up to 40 g/(L*h) per kU TP, at least 1.8 g/(L*h) per kU TP up to 30 g/(L*h) per kU TP, at least 1.8 g/(L*h) per kU TP up to 25 g/(L*h) per kU TP, at least 1.8 g/(L*h) per kU TP up to 20 g/(L*h) per kU TP, at least 1.8 g/(L*h) per kU TP up to 15 g/(L*h) per kU TP, at least 1.8 g/(L*h) per kU TP up to 10 g/(L*h) per kU TP, or at least 2.0 g/(L*h) per kU TP up to 90 g/(L*h) per kU TP, at least 2.0 g/(L*h) per kU TP up to 80 g/(L*h) per kU TP, at least 2.0 g/(L*h) per kU TP up to 70 g/(L*h) per kU TP, at least 2.0 g/(L*h) per kU TP up to 60 g/(L*h) per kU TP, at least 2.0 g/(L*h) per kU TP up to 50 g/(L*h) per kU TP, at least 2.0 g/(L*h) per kU TP up to 40 g/(L*h) per kU TP, at least 2.0 g/(L*h) per kU TP up to 30 g/(L*h) per kU TP, at least 2.0 g/(L*h) per kU TP up to 25 g/(L*h) per kU TP, at least 2.0 g/(L*h) per kU TP up to 20 g/(L*h) per kU TP, at least 2.0 g/(L*h) per kU TP up to 15 g/(L*h) per kU TP, or at least 2.0 g/(L*h) per kU TP up to 10 g/(L*h) per kU TP.

In a preferred embodiment of the invention, the at least one trehalose phosphorylase characterized by one or more of the characteristics selected from the group consisting of the characteristics (A), (B), (C), and (D), and enabling the performance of a three-enzyme process comprising the steps of mixing and reacting, in any order, at least one alpha-phosphorylase, preferably a sucrose phosphorylase, at least one glucose isomerase and at least one trehalose phosphorylase with the specified Productivity per kU of TP enzyme of trehalose from sucrose, is a trehalose phosphorylase variant according to any one of the aspects and/or embodiments described herein.

In an equally preferred embodiment of any one of the aspects and embodiments described herein, the at least one trehalose phosphorylase is characterized by one or more of the characteristics selected from the group consisting of the characteristics (A), (B), (C), and (D), and enables the performance of a two-enzyme process comprising the steps of mixing and reacting, in any order, at least one saccharide raw material, at least one phosphorous source, at least a glucose substrate, at least one alpha-phosphorylase, and at least one trehalose phosphorylase without the addition of a glucose isomerase, wherein the Productivity per kU of TP enzyme of trehalose from saccharide raw material is at least 3 g/(L*h) per kU TP to 100 g/(L*h) per kU TP, at least 3.1 g/(L*h) per kU TP up to 100 g/(L*h) per kU TP, at least 3.2 g/(L*h) per kU TP up to 100 g/(L*h) per kU TP, at least 3.3 g/(L*h) per kU TP up to 100 g/(L*h) per kU TP, at least 3.4 g/(L*h) per kU TP up to 100 g/(L*h) per kU TP, at least 3.5 g/(L*h) per kU TP up to 100 g/(L*h) per kU TP, at least 3.6 g/(L*h) per kU TP up to 100 g/(L*h) per kU TP, at least 3.7 g/(L*h) per kU TP up to 100 g/(L*h) per kU TP, at least 3.8 g/(L*h) per kU TP up to 100 g/(L*h) per kU TP, at least 3.9 g/(L*h) per kU TP up to 100 g/(L*h) per kU TP, or at least 4 g/(L*h) per kU TP to 100 g/(L*h) per kU TP, at least 4.1 g/(L*h) per kU TP up to 100 g/(L*h) per kU TP, at least 4.2 g/(L*h) per kU TP up to 100 g/(L*h) per kU TP, at least 4.3 g/(L*h) per kU TP up to 100 g/(L*h) per kU TP, at least 4.4 g/(L*h) per kU TP up to 100 g/(L*h) per kU TP, at least 4.5 g/(L*h) per kU TP up to 100 g/(L*h) per kU IF, at least 4.6 g/(L*h) per kU TP up to 100 g/(L*h) per kU TP, at least 4.7 g/(L*h) per kU TP up to 100 g/(L*h) per kU TP, at least 4.8 g/(L*h) per kU TP up to 100 g/(L*h) per kU TP, at least 4.9 g/(L*h) per kU TP up to 100 g/(L*h) per kU TP, at least 5 g/(L*h) per kU TP up to 100 g/(L*h) per kU TP, or at least 3 g/(L*h) per kU TP up to 90 g/(L*h) per kU TP, at least 3 g/(L*h) per kU TP up to 80 g/(L*h) per kU TP, at least 3 g/(L*h) per kU TP up to 70 g/(L*h) per kU TP, at least 3 g/(L*h) per kU TP up to 60 g/(L*h) per kU TP, at least 3 g/(L*h) per kU TP up to 50 g/(L*h) per kU TP, at least 3 g/(L*h) per kU TP up to 40 g/(L*h) per kU TP, at least 3 g/(L*h) per kU TP up to 30 g/(L*h) per kU TP, or at least 4 g/(L*h) per kU TP up to 90 g/(L*h) per kU TP, at least 4 g/(L*h) per kU TP up to 80 g/(L*h) per kU TP, at least 4 g/(L*h) per kU TP up to 70 g/(L*h) per kU TP, at least 4 g/(L*h) per kU TP up to 60 g/(L*h) per kU TP, at least 4 g/(L*h) per kU TP up to 50 g/(L*h) per kU TP, at least 4 g/(L*h) per kU TP up to 40 g/(L*h) per kU TP, at least 4 g/(L*h) per kU TP up to 30 g/(L*h) per kU TP, or at least 4.8 g/(L*h) per kU TP up to 90 g/(L*h) per kU TP, at least 4.8 g/(L*h) per kU TP up to 80 g/(L*h) per kU TP, at least 4.8 g/(L*h) per kU TP up to 70 g/(L*h) per kU IF, at least 4.8 g/(L*h) per kU TP up to 60 g/(L*h) per kU TP, at least 4.8 g/(L*h) per kU TP up to 50 g/(L*h) per kU TP, at least 4.8 g/(L*h) per kU TP up to 40 g/(L*h) per kU TP, at least 4.8 g/(L*h) per kU TP up to 30 g/(L*h) per kU TP, or at least 4.25 g/(L*h) per kU TP up to 25 g/(L*h) per kU TP, at least 4.5 g/(L*h) per kU TP up to 20 g/(L*h) per kU TP, or at least 4.75 g/(L*h) per kU TP up to 15 g/(L*h) per kU TP, Preferably, the at least one alpha-phosphorylase is sucrose phosphorylase, and preferably the saccharide raw material is sucrose.

In a preferred embodiment of the invention, the at least one trehalose phosphorylase characterized by one or more of the characteristics selected from the group consisting of the characteristics (A), (B), (C), and (D), and enabling the performance of a two-enzyme process comprising the steps of mixing and reacting, in any order, a glucose substrate, at least one alpha-phosphorylase, and at least one trehalose phosphorylase without the addition of a glucose isomerase with the specified Productivity per kU of TP enzyme of trehalose from saccharide raw material, is a trehalose phosphorylase variant of any one of the aspects and/or embodiments described herein.

In another preferred embodiment of the first aspect, which is also a preferred embodiment of all previous embodiments, the at least one trehalose phosphorylase is a trehalose phosphorylase variant, wherein the variant comprises or consists of an amino acid sequence, wherein the amino acid sequence is at least 20% homologous and/or identical to the amino acid sequence of SEQ NO: 1, wherein the variant comprises or consists of two up to 15, three up to 15, four up to 15, five up to 15, six up to 15, seven up to 15, eight up to 15, nine up to 15, ten up to 15, eleven up to 15, twelve up to 15, thirteen up to 15, fourteen up to 15, or fifteen of the following amino acid positions selected from the group consisting of a) 712A, 712G, 712I, 712M, 712P or 712V, preferably 712M, and/or
b) 383A, 383G, 383I, 383, 383M, 383V, 383N, 383C, 383Q, 383S or 383T, preferably 383A, 383G, 383M, 383V, 383N, 383C, 383Q, 383S or 383T, more preferably 383G, 383V, 383C, 383S or 383T, even more preferably 383V or 383T, and most preferably 383V, and/or
c) 114A, 114G, 114I, 114M, 114P or 114V, preferably 114I, and/or
d) 118 is 118A, 118G, 118I, 118L, 118M, 118P or 118V, preferably 118V, and/or
e) 225A, 225G, 225I, 225L, 225M, 225P or 225V, preferably 225I, 225L, 225M or 225V and more preferably 225V, and/or
f) 304G, 304I, 304L, 304M, 304P or 304V, preferably 304I or 304L, and more preferably 304I, and/or
g) 323A, 323G, 323I, 323L, 323M, 323P, or 323V, preferably 323I or 323V, and more preferably 323I, and/or
h) 349W or 349Y, preferably 349Y, and/or
i) 357A, 357I, 357L, 357M, 357P or 357V, preferably 357A, and/or
j) 487A, 487G, 487I, 487L, 487M, 487P or 487V, preferably 487A. 487M, 487G, 487L or 487V, more preferably 487A. and/or
k) 550A, 550G, 550I, 550L, 550M or 550P, preferably 550I or 550P, and more preferably 550I, and/or
l) 556N, 556C, 556Q or S556T, preferably 556T and/or
m) 564D or 564E, preferably 564E, and/or
n) 590N, 590C, 590Q, 590S, 590T, 590A, 590G, 590I, 590L, 590M, 590P or 590V, preferably 590N, 590G or 590A, more preferably 590N, and/or
o) 649D or 649E, preferably 649E wherein the amino acid numbering refers to an aligning position in SEQ ID NO: 1.

It will be understood by a person skilled in the art how to identify amino acids positions of any wild type sequence of a trehalose phosphorylase enzyme that is corresponding to the abovementioned positions in SEQ ID NO: 1. For clarification, and without limiting the disclosure of this invention, Table 1 shows the numbering and amino acid in sequence positions of further wild types trehalose phosphorylase enzymes, which correspond to the positions 114, 118, 225, 304, 323, 349, 383, 487, 550, 556, 564, 590, 649, and 712 of SEQ ID NO: 1. For example, the comparable positions in the *Grifola frondosa* trehalose phosphorylase correspond to the positions of the last sentence are positions 108, 112, 221, 300, 319, 345, 379, 483, 544, 550, 558, 584, 643, 707 of SEQ ID NO: 160.

For the purpose of the invention, any substitution in amino acid positions of trehalose phosphorylase enzymes, which are indispensable for the catalytic activity of the trehalose phosphorylase, in particular any substitution at the amino acids positions D379. H403, R507 and K512 of the trehalose phosphorylase of SEQ ID NO: 1, or any substitution at the amino acid positions D375, H399. R503 abd K508 of the trehalose phosphorylases of SEQ ID NO: 81 and/or SEQ ID NO: 160, or any analogous position(s) of other trehalose phosphyorylase enzymes described and known in the art, shall be excluded from being substituted in creating trehalose phosphorylase enzyme variants according to the present invention.

In a preferred embodiment, the trehalose phosphorylase variant as defined herein comprises or consists of an amino acid sequence, wherein the amino acid sequence is at least 77% homologous and/or identical to the amino acid sequence of SEQ ID NO: 1, wherein the variant, or the polypeptide comprises an amino acid substitution at two or more of amino acid positions selected from the group consisting of amino acid position 383, 114, 225, 304, 323, 349, 357, 550, 556, 564 and 649, wherein the amino acid numbering refers to an aligning position in SEQ ID NO: 1.

Preferably, in this context, the trehalose phosphorylase variant comprises at least one further amino acid substitution at an amino acid position selected from the group consisting of amino acid position 712, 118, 487 and 590, wherein the amino acid numbering refers to an aligning position in SEQ ID NO: 1.

In this context, the trehalose phosphorylase variant is preferably characterized in that the homology and/or the identity of the amino acid sequence to SEQ ID NO: 1 is at least 77.1%, is at least 77.2%, is at least 77.3%, is at least 77.4%, is at least 77.5%, is at least 77.6%, is at least 77.7%, is at least 77.8%, is at least 77.9%, 78.0%, is at least 78.1%, is at least 78.2%, is at least 78.3%, is at least 78.4%, is at least 78.5%, is at least 78.6%, is at least 78.7%, is at least 78.8%, is at least 78.9%, 79.0%, is at least 79.1%, is at least 79.2%, is at least 79.3%, is at least 79.4%, is at least 79.5%, is at least 79.6%, is at least 79.7%, is at least 79.8%, is at least 79.9%, is at least 80%, is at least 81%, is at least 82%, is at least 83%, is at least 84%, and preferably is at least 85%, or at least 86%, or at least 87%, or at least 88%, or at least 89%, and more preferably is at least 90%, or at least 91%, or at least 92%, or at least 93%, or at least 94%, or at least 95, and even more preferably at least 96%, or at least 97%, or at least 98%, and most preferably at least 99%, at least 99.1%, or at least 99.2%, or at least 99.3%, or at least 99.4%, or at least 99.5%, or at least 99.6%, or at least 99.7%, or at least 99.8%, and in particular at least 99.9%, or 100%.

In another preferred embodiment of the first aspect, which is also a preferred embodiment of all previous embodiments relating thereto, the trehalose phosphorylase variant comprises or consists of an amino acid sequence, wherein the amino acid sequence is at least 68% homologous and/or identical to the amino acid sequence of SEQ NO: 1, wherein the variant, or the polypeptide comprises an amino acid substitution at two or more of amino acid positions selected from the group consisting of amino acid position 383, 114, 225, 304, 323, 349, 357, 550, 556, and 564, wherein the amino acid numbering refers to an aligning position in SEQ ID NO: 1.

Preferably, in this context, the variant comprises at least one further amino acid substitution at an amino acid position selected from the group consisting of amino acid position 712, 118, 487, 590, and 649, wherein the amino acid numbering refers to an aligning position in SEQ ID NO: 1.

In this context, the trehalose phosphorylase variant is preferably characterized in that the homology and/or the identity of the amino acid sequence to SEQ ID NO: 1 is at least 69%, is at least 70%, is at least 71%, is at least 72%, is at least 73%, is at feast 74%, is at least 75%, or at least 76%, or at least 77%. 77.1%, is at least 77.2%, is at least 77.3%, is at least 77.4%, is at least 77.5%, is at least 77.6%, is at least 77.7%, is at least 77.8%, is at least 77.9%. 78.0%, is at least 78.1%, is at least 78.2%, is at least 78.3%, is at least 78.4%, is at least 78.5%, is at least 78.6%, is at least 78.7%, is at least 78.8%, is at least 78.9%, 79.0%, is at least 79.1%, is at least 79.2%, is at least 79.3%, is at least 79.4%, is at least 79.5%, is at least 79.6%, is at least 79.7%, is at least 79.8%, is at least 79.9%, is at least 80%, is at least 81%, is at least 82%, is at least 83%, is at least 84%, and preferably is at least 85%, or at least 86%, or at least 87%, or at least 88%, or at least 89%, and more preferably is at least 90%, or at least 91%, or at least 92%, or at least 93%, or at least 94%, or at least 95, and even more preferably at least 96%, or at least 97%, or at least 98%, and most preferably at least 99%, at least 99.1%, or at least 99.2%, or at least 99.3%, or at least 99.4%, or at least 99.5%, or at least 99.6%, or at least 99.7%, or at least 99.8%, and in particular at least 99.9% or 100%.

In another preferred embodiment of the first aspect, which is also a preferred embodiment of all previous embodiments relating thereto, the variant comprises or consists of an amino acid sequence, wherein the amino acid sequence is at least 63% homologous and/or identical to the amino acid sequence of SEQ ID NO: 1, wherein the variant, or the polypeptide comprises an amino acid substitution at two or more of amino acid positions selected from the group consisting of amino acid position 383, 114, 225, 304, 323, 349, 357, 556, and 564, wherein the amino acid numbering refers to an aligning position in SEQ ID NO: 1.

Preferably, in this context, the variant comprises at least one further amino acid substitution at an amino acid position selected from the group consisting of amino acid position 712, 118, 487, 550, 550, 590, and 649, wherein the amino acid numbering refers to an aligning position in SEQ ID NO: 1.

In this context, the trehalose phosphorylase variant is preferably characterized in that the homology and/or the identity of the amino acid sequence to SEQ ID NO: 1 is at least 64%, or at least 65%, or at least 66%, or at least 67%, or at least 68%, or at least 69%, is at least 70%, is at least 71%, is at least 72%, is at least 73%, is at least 74%, is at least 75%, or at least 76%, or at least 77%, 77.1%, is at least 77.2%, is at least 77.3%, is at least 77.4%, is at least 77.5%, is at least 77.6%, is at least 77.7%, is at least 77.8%, is at least 77.9%, 78.0%, is at least 78.1%, is at least 78.2%, is at least 78.3%, is at least 78.4%, is at least 78.5%, is at least 78.6%, is at least 78.7%, is at least 78.8%, is at least 78.9%, 79.0%, is at least 79.1%, is at least 79.2%, is at least 79.3%, is at least 79.4%, is at least 79.5%, is at least 79.6%, is at least 79.7%, is at least 79.8%, is at least 79.9%, is at least 80%, is at least 81%, is at least 82%, is at least 83%, is at least 84%, and preferably is at least 85%, or at least 86%, or at least 87%, or at least 88%, or at least 89%, and more preferably is at least 90%, or at least 91%, or at least 92%, or at least 93%, or at least 94%, or at least 95, and even more preferably at least 96%, or at least 97%, or at least 98%, and most preferably at least 99%, at least 99.1%, or at least 99.2%, or at least 99.3%, or at least 99.4%, or at least 99.5%, or at least 99.6%, or at least 99.7%, or at least 99.8%, and in particular at least 99.9%, or 100%.

Preferably, the trehalose phosphorylase of the present invention comprises or consists of an amino acid sequence selected from the group of sequences consisting of SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 87, SEQ ID NO: 89, SEQ ID NO: 104, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 150, SEQ ID NO: 151, SEQ ID NO: 152, SEQ ID NO: 153, SEQ ID NO: 154, SEQ ID NO: 155, SEQ ID NO: 156, SEQ ID NO: 157, SEQ ID NO: 158, SEQ ID NO: 159, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, and SEQ ID NO: 190.

More preferably, the trehalose phosphorylase of the present invention comprises or consists of an amino acid sequence selected from the group of sequences consisting of SEQ ID NO: 3, SEQ ID NO: 7, SEQ ID NO: 9, SEQ ID NO: 10, SEQ ID NO: 12, SEQ ID NO: 13, SEQ ID NO: 15, SEQ ID NO: 20, SEQ ID NO: 44, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 110, SEQ ID NO: 113, SEQ ID NO: 115, SEQ ID NO: 121, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 152, SEQ ID NO: 154, SEQ ID NO: 155, SEQ ID NO: 156, SEQ ID NO: 157, SEQ ID NO: 158, SEQ ID NO: 159, SEQ ID NO: 190, SEQ ID NO: 176, SEQ ID NO: 178, SEQ ID NO: 180, SEQ ID NO: 185, and SEQ ID NO: 188.

In a preferred embodiment of the invention, the trehalose phosphorylase variant of any one of the embodiments described herein is a trehalose phosphorylase characterized by one or more of the characteristics selected from the group consisting of the characteristics (A), (B), (C), and (D), as described in any one of the aspects and/or embodiments described herein.

Preferably, the trehalose phosphorylase variant of any one of the aspects and/or embodiments described herein is a trehalose phosphorylase variant characterized by one or more of the characteristics selected from the group consisting of the characteristics (A), (B), (C), and (D):
(A) a thermal stability, wherein the thermal stability is characterized by a residual enzymatic activity of from 30% to 100% after incubation of the enzyme at 52° C. for 15 minutes; and/or
(B) a thermal stability, wherein the thermal stability is characterized by a $Tm_{50}$-value of at least 52° C. after incubation of the enzyme at 52° C. for 15 minutes; and/or
(C) a thermal stability, wherein the thermal stability is characterized by a $Tm_{50}$-value of between 52° C. and 90° C. after incubating the enzyme at 52° C. for 15 minutes; and/or
(D) a thermal stability, wherein the thermal stability is in the form of a process stability characterized by a half-life of from 3 hours to 9 days or more, preferably by a half-life of from 24 hours to 9 days or more, more preferably by a half-life of 4 days to 9 days or more.

Preferably, the trehalose phosphorylase variant of any one of the aspects and/or embodiments described herein is a trehalose phosphorylase variant characterized by one or more of the characteristics selected from the group consisting of the characteristics (A), (B), (C), and (D), wherein the variant further
(i) provides a Productivity per kU TP enzyme as described in any one of the aspects and/or embodiments described herein; and/or
(ii) enables the performance of a two-enzyme process comprising the steps of mixing and reacting, in any order, a glucose substrate, at least one alpha-phosphorylase, and at least one trehalose phosphorylase without the addition of a glucose isomerase, with a Productivity per kU of TP enzyme of trehalose from saccharide raw material as described in any one of the aspects and/or embodiments described herein; and/or
(iii) enables the performance of a three-enzyme process comprising the steps of mixing and reacting, in any order, at least one alpha-phosphorylase, preferably a sucrose phosphorylase, at least one glucose isomerase and at least one trehalose phosphorylase, with a Productivity per kU of TP enzyme of trehalose from sucrose as described in any one of the aspects and/or embodiments described herein.

Preferably, the trehalose phosphorylase variant of any one of the aspects and/or embodiments described herein is characterized in that it
(i) enables a Productivity per kU of TP enzyme of trehalose from the saccharide raw material sucrose of at least 1.0 g/(L*h) per kU TP to 100 g/(L*h) per kU TP; and/or
(ii) enables a three-enzyme process comprising the steps of mixing and reacting, in any order, at least one alpha-phosphorylase, preferably a sucrose phosphorylase, at least one glucose isomerase and at least one trehalose phosphorylase (TP), wherein the Productivity per kU TP enzyme of trehalose from sucrose is at least 1.0 g/(L*h) per kU TP to 100 g/(L*h) per kU TP; and/or
(iii) enables a two-enzyme process comprising the steps of mixing and reacting, in any order, a glucose substrate, at least one alpha-phosphorylase, and at least one trehalose phosphorylase (TP) without the addition of a glucose isomerase, wherein the Productivity per kU of TP enzyme of trehalose from saccharide raw material is at least 3 g/(L*h) per kU TP to 100 g/(L*h) per kU TP, wherein preferably, the at least one alpha-phosphorylase is sucrose phosphorylase, and wherein the saccharide raw material is preferably sucrose.

In another preferred embodiment of the first aspect, which is also a preferred embodiment of all previous embodiments relating thereto, the trehalose phosphorylase comprises or consists of an amino acid sequence, wherein the amino acid sequence is at least 80% identical to and/or at least 80% homologous to the amino acid sequence of SEQ ID NO: 1, wherein the amino acid sequence of the trehalose phosphorylase comprises an amino acid substitution at one or more amino acid positions, wherein the one or more amino acid positions is/are selected from the group consisting of amino acid positions 712, 383, 10, 114, 118, 192, 197, 220, 225, 304, 306, 318, 323, 339, 349, 357, 459, 476, 481, 484, 487, 488, 506, 511, 526, 530, 532, 533, 537, 550, 556, 564, 590, 649, 667, 703 and 705 of SEQ ID NO: 1, preferably wherein the one or more amino acid positions is/are selected from the group consisting of amino acid positions 712, 383, 114, 118, 192, 197, 220, 225, 304, 306, 318, 323, 339, 349, 357, 459, 476, 481, 484, 487, 488, 506, 511, 526, 530, 532, 533, 537, 550, 556, 564, 590, 667, 703 and 705 of SEQ ID NO: 1, more preferably wherein the one or more amino acid positions is/are selected from the group consisting of amino acid positions 712, 383, 114, 118, 225, 304, 323, 349, 357, 487, 550, 556, 564, 590 and 649 of SEQ ID NO: 1, and most preferably wherein the one or more amino acid positions is/are selected from the group consisting of amino acid positions 383, 225, 304, 323, 487, 550, 556, 564, 590, and 705.

Preferably, the trehalose phosphorylase comprises or consists of an amino acid sequence, wherein the amino acid sequence is at least 80% identical to and/or at least 80% homologous to an amino acid sequence of SEQ ID NO: 1, wherein the amino acid sequence of the trehalose phosphorylase comprises an amino acid substitution at one or more amino acid positions, wherein the one or more amino acid positions is/are selected from the group consisting of amino acid positions L712. P383, V10, L114, I118, S192, 5197, Y220, N225, A304, D306, P318, T323, L339, F349, G357, A459, Q476, E481, A484, Q487, K488, A506, A511, R526, E530, G532, D533, D537, V550, S556, T564, D590, A649, R667, A703 and K705, preferably wherein the one or more amino acid positions is/are selected from the group consisting of amino acid positions L712, P383, L114, 1118, 5192. S197, Y220. N225, A304, D306, P318, 1323. L339, F349, G357, A459, Q476, E481, A484, Q487, K488, A506, A511, R526, E530, G532, D533, D537, V550, S556, T564, D590, R667, A703 and K705, more preferably wherein the one or more amino acid positions is/are selected from the group consisting of amino acid positions L712, P383, L114, I118, N225, A304, T323, F349, G357, Q487, V550, S556, T564, D590 and A649, most preferably wherein the one or more amino acid positions is/are selected from the group consisting of amino acid positions P383. N225, A304, T323, Q487, V550, S556, T564, D590 and K705.

In a preferred embodiment thereof, which is also a preferred embodiment of all of the previous embodiments described herein, the amino acid sequence of the trehalose phosphorylase comprises one or more substitutions, wherein the substitution is selected from the group consisting of an amino acid substitution at position V10 of SEQ ID NO: 1 with the substitution being V10R, V10H or V10K, preferably V10R;

an amino acid substitution at position L114 of SEQ ID NO: 1 with the substitution being L114A, L114G, L114I, L114M, L114P or L114V, preferably L114I;

an amino acid substitution at position I118 of SEQ ID NO: 1 with the substitution being I118A, I118G, I118L, I118M, I118P or I118V, preferably I118V;

an amino acid substitution at position S192 of SEQ ID NO: 1 with the substitution being S192A, S192G, S192I, S192L, S192M, S192P or S192V, preferably S192V;

an amino acid substitution at position S197 of SEQ ID NO: 1 with the substitution being S197A, S197G, S197I, S197L, S197M, S197P or S197V, preferably S197G;

an amino acid substitution at position Y220 of SEQ ID NO: 1 with the substitution being Y220F or Y220W, preferably Y220F;

an amino acid substitution at position N225 of SEQ ID NO: 1 with the substitution being N225A, N225G, N225I, N225L, N225M, N225P or N225V, preferably N225V;

an amino acid substitution at position A304 of SEQ ID NO: 1 with the substitution being A304G, A304I, A304L, A304M, A304P or A304V, preferably A304I;

an amino acid substitution at position D306 of SEQ ID NO: 1 with the substitution being 0306R, D306H or D306K, preferably D306H;

an amino acid substitution at position P318 of SEQ ID NO: 1 with the substitution being P318R, P318H or P318K, preferably P318H;

an amino acid substitution at position T323 of SEQ ID NO: 1 with the substitution being T323A, T323G, T323I, T323L, T323M, T323P, or 323V, preferably T323I;

an amino acid substitution at position L339 of SEQ ID NO: 1 with the substitution being L339A, L339G, L339I, L339L, L339M, L339P or L339V, preferably L339I;

an amino acid substitution at position F349 of SEQ ID NO: 1 with the substitution being F349W or F349Y, preferably F349Y;

an amino acid substitution at position G357 of SEQ ID NO: 1 with the substitution being G357A, G357I, G357L, G357M, G357P or G357V, preferably G357A;

an amino acid substitution at position P383 of SEQ ID NO: 1 with the substitution being P383A, P383G, P383I, P383L, P383M, P383V, P383N, P383C, P383Q, P383S or P383I, preferably P383V or P383S, more preferably P383V;

an amino acid substitution at position A459 of SEQ ID NO: 1 with the substitution being A459N, A459C, A459Q or A459S, A459I, preferably A459S;

an amino acid substitution at position Q476 of SEQ ID NO: 1 with the substitution being Q476A, Q476G, Q476I, Q476L, Q476M, Q476P or Q476V, preferably Q476G;

an amino acid substitution at position E481 of SEQ ID NO: 1 with the substitution being E481A, E481G, E481I, E481L, E481M, E481P or E481V, preferably E481I;

an amino acid substitution at position A484 of SEQ ID NO: 1 with the substitution being A484N, A484C, A484Q, A484S or A484T, preferably A484S;

an amino acid substitution at position Q487 of SEQ ID NO: 1 with the substitution being Q487A, Q487G, Q487I, Q487L, Q487M, 0487P or Q487V, preferably Q487A, Q487G, Q487L or Q487V, more preferably Q487A;

an amino acid substitution at position K488 of SEQ ID NO: 1 with the substitution being K488A, K488G, K488I, K488L, K488M, K488P or K488V, preferably K488A;

an amino acid substitution at position A506 of SEQ ID NO: 1 with the substitution being A506N, A506C, A506Q, A506S or A506T, preferably A506S;

an amino acid substitution at position A511 of SEQ ID NO: 1 with the substitution being A511N, A511C, A511Q, A511S or A511T, preferably A511S;

an amino acid substitution at position R526 of SEQ ID NO: 1 with the substitution being R526D or R526E preferably R526E;

an amino acid substitution at position E530 of SEQ ID NO: 1 with the substitution being E530A, E530G, E530I, E530L, E530M, E530P, E530V, preferably E530V;

an amino acid substitution at position G532 of SEQ ID NO: 1 with the substitution being G532R, G532H or G532K, preferably G532R;

an amino acid substitution at position D533 of SEQ ID NO: 1 with the substitution being 0533A, D533G, D533I, D533L, D533M. D533P or D533V, preferably 0533G;

an amino acid substitution at position D537 of SEQ ID NO: 1 with the substitution being D537A. D537G, D537I, D537L, D537M, D537P or D537V, preferably D537M;

an amino acid substitution at position V550 of SEQ ID NO: 1 with the substitution being V550A, V550G, V550I, V550L, V550M or V550P, preferably V550I;

an amino acid substitution at position 5556 of SEQ ID NO: 1 with the substitution being S556N, S556C, S556Q or S556T, preferably S556T;

an amino acid substitution at position T564 of SEQ ID NO: 1 with the substitution being T564D or T564E, preferably T564E;

an amino acid substitution at position D590 of SEQ ID NO: 1 with the substitution being D590N, D590C, D590Q, D590S, D590T, D590A, D590G, D590I, D590L. D590M, D590P or D590V, preferably D590N or D590A, more preferably D590N;

an amino acid substitution at position A649 of SEQ ID NO: 1 with the substitution being A649D or A649E, preferably A649E;

an amino acid substitution at position 8667 of SEQ ID NO: 1 with the substitution being R667D, R667E. R667R. R667H or R667K, preferably R667E or R667K, more preferably R667E;

an amino acid substitution at position A703 of SEQ ID NO: 1 with the substitution being A7030 or A703E, preferably A703E;

an amino acid substitution at position K705 of SEQ ID NO: 1 with the substitution being K705N, K705C, K705Q, K705S or K705T, preferably K705N; and an amino acid substitution at position L712 of SEQ ID NO: 1 with the substitution being L712A, L712G, L712I, L712M, L712P or L712V, preferably L712M.

Preferably, the trehalose phosphorylase comprises or consists of an amino acid sequence selected from the group of sequences consisting of SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30. SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ. ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78. SEQ ID NO: 79, SEQ ID NO: 87, SEQ ID NO: 89, SEQ ID NO: 104, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 150, SEQ ID NO: 151, SEQ ID NO: 152, SEQ ID NO: 153, SEQ ID NO: 154, SEQ ID NO: 155, SEQ ID NO: 156, SEQ ID NO: 157, SEQ ID NO: 158, SEQ ID NO: 159 and SEQ ID NO: 190.

Preferably, the amino acid sequence is selected from the group of sequences consisting of SEQ ID NO: 7, SEQ ID NO: 9, SEQ ID NO: 10, SEQ ID NO: 12, SEQ ID NO: 13, SEQ ID NO: 15, SEQ ID NO: 20, SEQ ID NO: 44, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 110, SEQ ID NO: 113, SEQ ID NO: 115, SEQ ID NO: 121, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 152, SEQ ID NO: 154, SEQ ID NO: 155, SEQ ID NO: 156, SEQ ID NO: 157, SEQ ID NO: 158, SEQ ID NO: 159 and SEQ ID NO: 190.

In context of this embodiment of the first aspect and any of the preferred embodiments thereof, the trehalose phosphorylase variant is preferably characterized in that the homology and/or the identity of the amino acid sequence to SEQ ID NO: 1 is at least 81%, or at least 82%, or at least 83%, or at least 84%, or at least 85%, still more preferably at least 86%, or at least 87%, or at least 88%, or at least 89%, or at least 90%, yet more preferably at least 91%, or at least 92%, or at least 93%, or at least 94%, or at least 95%, and most preferably at least 96%, or at least 97%, or at least 98%, or at least 99%, at least 99.1%, or at least 99.2%, or at least 99.3%, or at least 99.4%, or at least 99.5%, or at least 99.6%, or at least 99.7%, or at least 99.8%, and in particular at least 99.9%, or 100%.

In a preferred embodiment of the invention, the trehalose phosphorylase variant of any one of the previous embodiments is a trehalose phosphorylase characterized by one or more of the characteristics selected from the group consisting of the characteristics (A), (B), (C), and (D), as described in any one of the aspects and/or embodiments described herein.

Preferably, the trehalose phosphorylase variant of any one of the embodiments described herein is a trehalose phosphorylase characterized by one or more of the characteristics selected from the group consisting of the characteristics (A), (B), (C), and (D):

(A) a thermal stability, wherein the thermal stability is characterized by a residual enzymatic activity of from 30% to 100% after incubation of the enzyme at 52° C. for 15 minutes; and/or (B) a thermal stability, wherein the thermal stability is characterized by a Tm50-value of at least 52° C. after incubation of the enzyme at 52° C. for 15 minutes; and/or (C) a thermal stability, wherein the thermal stability is characterized by a Tm50-value of between 52° C. and 90° C. after incubating the enzyme at 52° C. for 15 minutes; and/or (D) a thermal stability, wherein the thermal stability is in the form of a process stability characterized by a half-life of from 3 hours to 9 days or more, preferably by a half-life of from 24 hours to 9 days or more, more preferably by a half-life of 4 days to 9 days or more.

Preferably, the trehalose phosphorylase variant of any one of the previous embodiments is a trehalose phosphorylase characterized by one or more of the characteristics selected from the group consisting of the characteristics (A), (B), (C), and (D) as described in any one of the aspects and/or embodiments described herein, and further (i) provides a Productivity per kU TP enzyme at a certain temperature as described in any one of the aspects and embodiments described herein; and/or (ii) enables the performance of a two-enzyme process comprising the steps of mixing and reacting, in any order, a glucose substrate, at least one alpha-phosphorylase, and at least one trehalose phosphorylase without the addition of a glucose isomerase as described in any one of the aspects and embodiments described herein; and/or (iii) enables the performance of a three-enzyme process comprising the steps of mixing and reacting, in any order, at least one alpha-phosphorylase, preferably a sucrose phosphorylase, at least one glucose isomerase and at least one trehalose phosphorylase, as described in any one of the aspects and embodiments described herein.

Preferably, the trehalose phosphorylase variant of any one of the embodiments described herein is characterized in that it (i) enables a Productivity per kU of TP enzyme of trehalose from the saccharide raw material sucrose of at least 1.0 g/(L*h) per kU TP to 100 g/(L*h) per kU TP; and/or (ii) enables a three-enzyme process comprising the steps of mixing and reacting, in any order, at least one alpha-phosphorylase, preferably a sucrose phosphorylase, at least one glucose isomerase and at least one trehalose phosphorylase (TP), wherein the Productivity per kU of TP enzyme of trehalose from sucrose is at least 1.0 g/(L*h) per kU TP to 100 g/(L*h) per kU TP; and/or (iii) enables a two-enzyme process comprising the steps of mixing and reacting, in any order, a glucose substrate, at least one alpha-phosphorylase, and at least one trehalose phosphorylase (TP) without the addition of a glucose isomerase, wherein the Productivity per kU of TP enzyme of trehalose from saccharide raw material is at least 3 g/(L*h) per kU TP to 100 g/(L*h) per kU TP, wherein preferably, the at least one alpha-phosphorylase is sucrose phosphorylase, and wherein the saccharide raw material is preferably sucrose.

In another preferred embodiment of the first aspect, which is also a preferred embodiment of all previous embodiments relating thereto, the trehalose phosphorylase variant comprises or consists of an amino acid sequence, wherein the amino acid sequence is at least 85% or 86% identical to, and/or at least 85% or 86% homologous to any one of the amino acid sequence of SEQ ID NO: 81 and/or SEQ ID NO: 160, preferably of SEQ ID NO: 160, wherein the amino acid sequence of the trehalose phosphorylase comprises an amino acid substitution at one or more amino acid positions, wherein the one or more amino acid positions is/are selected from the group consisting of amino acid positions 108, 112, 221, 300, 319, 345, 379, 483, 544, 550, 558, 584, 643, and 707 of SEQ ID NO: 81 or SEQ ID NO: 160, preferably of SEQ ID NO: 160, and which is/are preferably selected from the group consisting of amino acid positions 108, 112, 221, 300, 319, 379, 483, 544, 550, and 558 of SEQ ID NO: 81 or SEQ ID NO: 160, preferably of SEQ ID NO: 160, and which is/are more preferably selected from the group consisting of amino acid positions 108, 221, 319, 379, 483, 550, and 558 of SEQ ID NO: 81 or SEQ ID NO: 160, preferably SEQ ID NO: 160.

Preferably, the trehalose phosphorylase variant comprises or consists of an amino acid sequence, wherein the amino acid sequence is at least 85% or 86% identical to, and/or at least 85% or 86% homologous to the amino acid sequence of SEQ ID NO: 81, wherein the amino acid sequence of the trehalose phosphorylase comprises an amino acid substitution at one or more amino acid positions, wherein the one or more amino acid positions is/are selected from the group consisting of amino acid positions L108, V112, N221, A300, T319, F345, P379, I483, V544, 5550, 0558, N584, A643, and L707 of SEQ ID NO: 81, which is preferably selected from the group consisting of amino acid positions L108, V112, N221, A300, T319, P379, I483, V544, 5550, and Q558 of SEQ ID NO: 81, and which is more preferably selected from the group consisting of amino acid positions L108, V221, T319, P379, I483, 5550, and 558 of SEQ ID NO: 81.

Equally preferred, the trehalose phosphorylase variant comprises or consists of an amino acid sequence, wherein the amino acid sequence is at least 85% or 86% identical to, and/or at least 85% or 86% homologous to the amino acid sequence of SEQ ID NO: 160, wherein the amino acid sequence of the trehalose phosphorylase comprises an amino acid substitution at one or more amino acid positions, wherein the one or more amino acid positions is/are selected from the group consisting of amino acid positions L108, V112, N221, A300, T319, F345, P379, V483, V544, S550, Q558, N584, A643, and L707 of SEQ ID NO: 160, which is preferably selected from the group consisting of amino acid positions L108, V112, N221, A300, T319, P379, V483, V544, S550, and Q558 of SEQ ID NO: 160, and which is more preferably selected from the group consisting of amino acid positions L108, V221, T319, P379, V483, S550, and Q558 of SEQ ID NO: 160.

In a preferred embodiment thereof, which is also a preferred embodiment of all previous embodiments described herein, the amino acid sequence of the trehalose phosphorylase comprises one or more substitutions, wherein the substitution is selected from the group consisting of a) an amino acid substitution at position L108 of SEQ ID NO: 81 or SEQ ID NO: 160, preferably of SEQ ID NO: 160, with the substitution being L108A, L108G, L108I, L108M, L108P or L108V, preferably L108I;

b) an amino acid substitution at position V112 of SEQ ID NO: 81 or SEQ ID NO: 160, preferably of SEQ ID NO: 160, with the substitution being V112A, V112G, V112L, V112M, V112P or V112I, preferably V112I;

c) an amino acid substitution at position N221 of SEQ ID NO: 81 or SEQ ID NO: 160, preferably of SEQ ID NO: 160, with the substitution being N221A, N221G, N221I, N221L, N221M, N221P or N221V, preferably N221I, N221L, N221M or N221V, and more preferably N221V;

d) an amino acid substitution at position A300 of SEQ ID NO: 81 or SEQ ID NO: 160, preferably of SEQ ID NO: 160, with the substitution being A300G, A300I, A300L, A300M, A300P or A300V, preferably A300I or A300L, and more preferably A300I;

e) an amino acid substitution at position T319 of SEQ ID NO: 81 or SEQ ID NO: 160, preferably of SEQ ID NO: 160, with the substitution being T319A, T319G, T319I, I319L, T319M, T319P, or T319V, preferably T319I or T319V, and more preferably T319I;

f) an amino acid substitution at position P379 of SEQ ID NO: 81 or SEQ ID NO: 160, preferably of SEQ ID NO: 160, with the substitution being P379A. P379G, P379I, P379L, P379M, P379V, P379N, P379C, P379Q, P379S or P379T, preferably P379A, P379G, P379M, P379V, P379N, P379C, P379Q, P379S or P379T, more preferably P379G, P379V, P379C or P379S, or P379T, even more preferably P379V or P379T, and most preferably P379V;

g) an amino acid substitution at position 1483 of SEQ ID NO: 81 with the substitution being I483A, I483G, I483I, I483L, I483M, I483P or I483V, preferably I483A, I483G, I483L, I483M or I483V, more preferably I483A;

h) an amino acid substitution at position Q483 of SEQ ID NO: 160 with the substitution being Q483A, Q483G, Q483I, Q483L, Q483M, Q483P or Q483V, preferably Q483A, Q483G, Q483L, Q483M or Q483V, more preferably Q483A;

i) an amino acid substitution at position V544 of SEQ ID NO: 81 or SEQ ID NO: 160, preferably of SEQ ID NO: 160 with the substitution being V544A, V544G, V544I, V544L, V544M or V544P, preferably V544I or V544P, and more preferably V544I;

j) an amino acid substitution at position S550 of SEQ ID NO: 81 or SEQ ID NO: 160, preferably of SEQ ID NO: 160 with the substitution being S550N, S550C, S550Q or S550T, preferably S550T;

k) an amino acid substitution at position Q558 of SEQ ID NO: 81 or SEQ ID NO: 160, preferably of SEQ ID NO: 160 with the substitution being Q558D or Q558E, preferably Q558E;

l) an amino acid substitution at position D558 of SEQ ID NO: 81 or SEQ ID NO: 160, preferably of SEQ ID NO: 160 with the substitution being D558N, D558C, D558O, D558S, D558T, D558A, D558G, D558I, D558L, D558M, D558P or D558V, preferably D558N, D558G or D558A, and more preferably D558N;

m) an amino acid substitution at position A643 of SEQ ID NO: 81 or SEQ ID NO: 160, preferably of SEQ ID NO: 160 with the substitution being A643D or A643E, preferably A643E;

n) an amino acid substitution at position L707 of SEQ ID NO: 81 or SEQ ID NO: 160, preferably of SEQ ID NO: 160 with the substitution being L707A, L707G, L707I, L707M, L707P or L707V, preferably L707M.

Preferably, in this context, the trehalose phosphorylase comprises or consists of an amino acid sequence selected from the group of sequences consisting of SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, and SEQ ID NO: 189, and preferably selected from the group of sequences consisting of SEQ ID NO: 176, SEQ ID NO: 178, SEQ ID NO: 180, SEQ ID NO: 185, and SEQ ID NO: 188.

In context of this embodiment of the first aspect and any preferred embodiments thereof, the trehalose phosphorylase variant is preferably characterized in that the homology and/or the identity of the amino acid sequence to SEQ ID NO: 81 and/or SEQ ID NO: 160, preferably of SEQ ID NO: 160 is at least 85%, still more preferably at least 86%, or at least 87%, or at least 88%, or at least 89%, or at least 90%, yet more preferably at least 91%, or at least 92%, or at least 93%, or at least 94%, or at least 95%, and most preferably at least 96%, or at least 97%, or at least 98%, or at least 99%, at least 99.1%, or at least 99.2%, or at least 99.3%, or at least 99.4%, or at least 99.5%, or at least 99.6%, or at least 99.7%, or at least 99.8%, and in particular at least 99.9%, or 100%.

In a preferred embodiment of the invention, the trehalose phosphorylase variant of any one of the previous embodiments is a trehalose phosphorylase variant characterized by one or more of the characteristics selected from the group consisting of the characteristics (A), (B), (C), and (D), as described in any one of the aspects and/or embodiments described herein.

Preferably, the trehalose phosphorylase variant of any one of the embodiments described herein is characterized by one or more of the characteristics selected from the group consisting of the characteristics (A), (B), (C), and (D):

(A) a thermal stability, wherein the thermal stability is characterized by a residual enzymatic activity of from 30% to 100% after incubation of the enzyme at 52° C. for 15 minutes; and/or (B) a thermal stability, wherein the thermal stability is characterized by a $Tm_{50}$-value of at least 52° C. after incubation of the enzyme at 52° C. for 15 minutes; and/or (C) a thermal stability, wherein the thermal stability is characterized by a $Tm_{50}$-value of between 52° C. and 90° C. after incubating the enzyme at 52° C. for 15 minutes; and/or (D) a thermal stability, wherein the thermal stability is in the form of a process stability characterized by a half-life of from 3 hours to 9 days or more, preferably by a half-life of from 24 hours to 9 days or more, more preferably by a half-life of 4 days to 9 days or more.

Preferably, the trehalose phosphorylase variant of any one of the previous embodiments is characterized by one or more of the characteristics selected from the group consisting of the characteristics (A), (B), (C), and (D) as described in any one of the aspects and/or embodiments described herein, and further (i) provides a Productivity per kU TP enzyme at a certain temperature as described in any one of the aspects and embodiments described herein; and/or (ii) enables the performance of a two-enzyme process comprising the steps of mixing and reacting, in any order, a glucose substrate, at least one alpha-phosphorylase, and at least one trehalose phosphorylase without the addition of a glucose isomerase as described in any one of the aspects and embodiments described herein; and/or (iii) enables the performance of a three-enzyme process comprising the steps of mixing and reacting, in any order, at least one alpha-phosphorylase, preferably a sucrose phosphorylase, at least one glucose isomerase and at least one trehalose phosphorylase, as described in any one of the aspects and embodiments described herein.

Preferably, the trehalose phosphorylase variant of any one of the embodiments described herein is characterized in that it (i) enables a Productivity per kU of TP enzyme of trehalose from the saccharide raw material sucrose of at least 1.0 g/(L*h) per kU TP to 100 g/(L*h) per kU TP; and/or (ii) enables a three-enzyme process comprising the steps of mixing and reacting, in any order, at least one alpha-phosphorylase, preferably a sucrose phosphorylase, at least one glucose isomerase and at least one trehalose phosphorylase (TP), wherein the Productivity per kU of TP enzyme of trehalose from sucrose is at least 1.0 g/(L*h) per kU TP to 100 g/(L*h) per kU TP; and/or (iii) enables a two-enzyme process comprising the steps of mixing and reacting, in any order, a glucose substrate, at least one alpha-phosphorylase, and at least one trehalose phosphorylase (TP) without the addition of a glucose isomerase, wherein the Productivity per kU of TP enzyme of trehalose from saccharide raw material is at least 3 g/(L*h) per kU TP to 100 g/(L*h) per kU TP, wherein preferably, the at least one alpha-phosphorylase is sucrose phosphorylase, and wherein the saccharide raw material is preferably sucrose.

In another preferred embodiment of the first aspect, which is also a preferred embodiment of all previous embodiments and preferred embodiments relating thereto, the method of the invention is characterized in that the at least one trehalose phosphorylase is a trehalose phosphorylase, preferably a trehalose variant, as defined in any of the previous embodiments described above.

More preferably, the method of the invention is characterized in that the at least one trehalose phosphorylase comprises or consists of an amino acid sequence selected from the group consisting of any one of a) SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53 SEQ ID NO: 54, SEQ ID NO: 55, SEQ ID NO: 56 SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 87. SEQ ID NO: 89, SEQ ID NO: 104, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 150, SEQ ID NO: 151, SEQ ID NO: 152, SEQ ID NO: 153, SEQ ID NO: 154, SEQ ID NO: 155, SEQ ID NO: 156, SEQ ID NO: 157, SEQ ID NO: 158, SEQ ID NO; 159, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186. SEQ ID NO: 187, SEQ ID NO: 188, SEQ ID NO: 189, and SEQ ID NO: 190, more preferably wherein the at least one trehalose phosphorylase comprises or consists of an amino acid sequence selected from the group of sequences consisting of SEQ ID NO: 3, SEQ ID NO: 7, SEQ ID NO: 9, SEQ ID NO: 10, SEQ ID NO: 12, SEQ ID NO: 13, SEQ ID NO: 15, SEQ ID NO: 20, SEQ ID NO: 44, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 110, SEQ ID NO: 113, SEQ ID NO: 115, SEQ ID NO: 121, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 152, SEQ ID NO: 154, SEQ ID NO: 155, SEQ ID NO: 156, SEQ ID NO: 157, SEQ ID NO: 158, SEQ ID NO: 159, SEQ ID NO: 190, SEQ ID NO: 176, SEQ ID NO: 178, SEQ ID NO: 180, SEQ ID NO: 185, and SEQ ID NO: 188; and/or b) SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO; 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41, SEQ ID NO: 42, SEQ ID NO: 43, SEQ ID NO: 44. SEQ ID NO: 45, SEQ ID NO: 46, SEQ ID NO: 47, SEQ ID NO: 48, SEQ ID NO: 49, SEQ ID NO: 50. SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 87, SEQ ID NO: 89, SEQ ID NO: 104, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 150, SEQ ID NO: 151, SEQ ID NO: 152, SEQ ID NO: 153, SEQ ID NO: 154, SEQ ID NO: 155, SEQ ID NO: 156, SEQ ID NO: 157, SEQ ID NO: 158, SEQ ID NO: 159 and SEQ ID NO: 190, and preferably selected from the group of sequences consisting of SEQ ID NO: 7, SEQ ID NO: 9, SEQ ID NO: 10, SEQ ID NO: 12, SEQ ID NO: 13, SEQ ID NO: 15, SEQ ID NO: 20, SEQ ID NO: 44, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 110, SEQ ID NO: 113, SEQ ID NO: 115, SEQ ID NO: 121, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 152, SEQ ID NO: 154, SEQ ID NO: 155, SEQ ID NO: 156, SEQ ID NO: 157, SEQ ID NO: 158, SEQ ID NO: 159 and SEQ ID NO: 190; and/or c) SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, and SEQ ID NO: 189, preferably selected from the group of sequences consisting of SEQ ID NO: 176, SEQ ID NO: 178, SEQ ID NO: 180, SEQ ID NO: 185, and SEQ ID NO: 188; and/or d) SEQ ID NO: 44, SEQ ID NO: 62, SEQ ID NO: 65, SEQ ID NO: 78, SEQ ID NO: 87, SEQ ID NO: 89, SEQ ID NO: 104, SEQ ID NO: 115, SEQ ID NO: 121, SEQ ID NO: 138, SEQ ID NO: 140, SEQ ID NO: 147, SEQ ID NO: 180, and SEQ ID NO: 188.

Equally preferred is that the at least one trehalose phosphorylase variant comprises or consists of an amino acid sequence selected from the group consisting of any one of SEQ ID NO: 2, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96. SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 161, SEQ ID NO: 162, SEQ ID NO: 163, SEQ ID NO: 164, SEQ ID NO: 165, SEQ ID NO: 166, SEQ ID NO:

167, SEQ ID NO: 168, SEQ ID NO: 169, and SEQ ID NO: 170, preferably selected from the group of sequences consisting of SEQ ID NO: 87, SEQ ID NO: 89, and SEQ ID NO: 104.

In another preferred embodiment of the first aspect, which is also a preferred embodiment of all previous embodiments relating thereto, the at least one alpha-phosphorylase is a sucrose phosphorylase, preferably a sucrose phosphorylase derived from an organism belonging to the class Actinobacteria, Bacilli, Betaproteobacteria, Clostridia, Garnmaproteobacteria or Bacilli, more preferably belonging to the order Bifidobacteriales or Lactobacillales, even more preferably belonging to the family Bifidobacteriaceae, Lactobacillaceae, Leuconostocaceae or Streptococcaceae, even more preferably belonging to the genus *Bifidobacterium* and most preferably belonging to the species *Bifidobacterium thermophilum* and *Bifidobacterium magnum*, and utmost preferably to the species *Bifidobacterium magnum*.

Preferably, in this context, the at least one alpha-phosphorylase is a sucrose phosphorylase, wherein the sucrose phosphorylase has at least 75% sequence identity and/or sequence homology to an amino acid sequence selected from the group consisting of SEQ ID NO: 202 and/or SEQ ID NO: 205, preferably of SEQ ID NO: 202.

Preferably, in this context, the at least one alpha-phosphorylase is a variant of a wild-type sucrose phosphorylase with at least 75% sequence identity and/or sequence homology to the amino acid sequence of SEQ ID NO: 202.

Even more preferably, the at least one alpha-phosphorylase is a variant of a wild-type sucrose phosphorylase from *Bifidobacterium magnum* with at least 75% sequence identity and/or sequence homology to the amino acid sequence of SEQ ID NO: 202.

In another preferred embodiment, the sucrose phosphorylase comprises or consists of an amino acid sequence with at least 84% homology and/or identity to SEQ ID NO: 202, wherein the amino acid sequence is engineered compared to SEQ ID NO: 202 such that it comprises one or more substitution at one or more amino acid positions, wherein the one or more amino acid positions is/are each and independently selected from the group consisting of the amino acid position 92, 124, 148, 188, 231, 371, 461, preferably wherein the one or more amino acid positions is/are each and independently selected from the group consisting of the amino acids positions 92, 124, 148, 188, 231, more preferably wherein the one or more amino acid positions is/are each and independently selected from the group consisting of the amino acids positions 124, 148, 188 and most preferably wherein the one or more amino acid positions is/are each and independently selected from the group consisting of the amino acids positions 148, 188.

Preferably, the amino acid sequence is, in addition, engineered compared to SEQ ID NO: 202 such that it comprises two or more substitutions, wherein the additional substitution amino acid positions are each and independently selected from the group consisting of the amino acid position 92, 124, 148, 157, 188, 231, 371, and 461.

Even more preferably, the sucrose phosphorylase comprises or consists of an amino acid sequence with at least 84% homology and/or identity to SEQ ID NO: 202, wherein the amino acid sequence is engineered compared to SEQ ID NO: 202 such that it comprises one or more substitution at one or more amino acid positions, wherein the one or more amino acid positions is/are each and independently selected from the group consisting of the amino acid position E92, S124, A148, Q188, I231, L371, T461, preferably wherein the one or more amino acid positions is/are each and independently selected from the group consisting of the amino acids positions E92, S124, A148, Q188, I231, more preferably wherein the one or more amino acid positions is/are each and independently selected from the group consisting of the amino acids positions S124, A148, Q188 and most preferably wherein the one or more amino acid positions is/are each and independently selected from the group consisting of the amino acids positions A148, 0188.

Equally more preferably, the amino acid sequence is, in addition, engineered compared to SEQ ID NO: 202 such that it comprises two or more substitutions, wherein the additional substitution amino acid positions are each and independently selected from the group consisting of the amino acid position E92, S124, A148, T157, Q188, I231, L371, and T461.

In another preferred embodiment of the first aspect, which is also a preferred embodiment of all previous embodiments, the amino acid sequence is engineered compared to SEQ ID NO: 202 such that it comprises one or more substitution at one or more amino acid positions, wherein substitution at the one or more amino acid positions is/are each and independently selected from the group consisting of the substitutions:

(i) position E92 is substituted with A, R, N, D, C, Q, G, H, I, L, K, M, F, P, S, T, W, Y, or V; preferably is substituted with A, I, L, or V; and most preferably is substituted with L;

(ii) position S124 is substituted with A, R, N, D, C, Q, E, G, H, I, L, K, M, F, P, T, W, Y, or V; preferably is substituted with R, H, K, N, M, C, S, T, or Q; even more preferably is substituted with Q, K, or T; still even more preferably is substituted with K, T; and most preferably substituted with K;

(iii) position A148 is substituted with R, N, D, C, Q, E, G, H, I, L, K, M, F, P, S, T, W, Y, or V; preferably is substituted with R, H, or K; more preferably is substituted with K, or R; and most preferably with K;

(iv) position T157 is substituted with A, R, N, D, C, Q, E, G, H, I, L, K, M, F, P, S, W, Y, or V; and preferably substituted with D;

(v) position Q188 is substituted with A, R, N, D, C, E, G, H, I, L, K, M, F, P, S, T, W, Y, or V; preferably is substituted with F, W. or Y; and most preferably is substituted with Y:

(vi) position I231 is substituted with A, R, N, D, C, Q, E, G, H, L, K, M, F, P, S, T, W, Y, or V; preferably is substituted with A, I, L, or V; and most preferably is substituted with V;

(vii) position L371 is substituted with A, R, N, D, C, Q, E, G, H, I, K, M, F, P, S, T, W, Y, or V; preferably is substituted with A, I, L, or V; and most preferably is substituted with A;

(viii) position T461 is substituted with A, R, N, D, C, Q, E, G, H, I, L, K, M, F, P. S. W. Y. or V; preferably is substituted with G, or P; and most preferably is substituted with G.

It is understood for the purpose of the invention, that alternative wild type alpha-phosphorylases, and preferably of sucrose phosphorylases, or variants thereof are selected, wherein the alternative sucrose phosphorylase enzymes and/or variants are distinguished by an increased thermal stability, by a low hydrolytic activity, and by an efficient production of alpha-glucose 1-phosphate at high sucrose concentrations in comparison to the wild-type sucrose phosphorylases in the art.

In another preferred embodiment, the sucrose phosphorylase has at least one of the characteristics (E), (F), (G), (H), or any combination thereof:
(E) a Tm50 value of at least 66.5° C. up to 90° C., and most preferably of at least 68.0° C. up to 72° C. at least 68.5° C. up to 72° C., or at least 68.0° C. up to 70° C.;
(F) a residual activity after 15 min incubation at 70° C. of at least 25% up to 100%, most preferably of at least of at least 50% up to 64%;
(G) NH-ratio of at least 200% up to 600%, most preferably of at least 275% up to 373%,
(H) aG1P formation activity in 24 hours from 1M sucrose and 1M phosphate at 30° C. using 20 U heat-purified sucrose phosphorylase of at least 300 mM up to 1000 mM, most preferably of at least 300 mM up to 501 mM, at least 350 mM up to 501 mM, at least 354 mM up to 501 mM, at least 367 mM up to 501 mM, at least 400 mM up to 501 mM, at least 422 mM up to 501 mM, at least 450 mM up to 501 mM, at least 484 mM up to 501 mM.

Preferably, in the context of the present invention, and preferably in the context of this preferred embodiment, the sucrose phosphorylase comprises or consists of an amino acid sequence selected from the group of sequences consisting of SEQ ID NO: 202, SEQ ID NO: 203, SEQ ID NO: 204, SEQ ID NO: 205, SEQ ID NO: 206, SEQ ID NO: 207, SEQ ID NO: 208, SEQ ID NO: 209, SEQ ID NO: 210, SEQ ID NO: 211, SEQ ID NO: 212, SEQ ID NO: 213, SEQ ID NO: 214, SEQ ID NO: 215, SEQ ID NO: 216, SEQ ID NO: 217, SEQ ID NO: 218 and SEQ ID NO: 219, preferably selected from the group of sequences consisting of SEQ ID NO: 207, SEQ ID NO: 208, SEQ ID NO: 209, SEQ ID NO: 210, SEQ ID NO: 211, SEQ ID NO: 212, SEQ ID NO: 213, SEQ ID NO: 214, SEQ ID NO: 215, SEQ ID NO: 216, SEQ ID NO: 217, SEQ ID NO: 218 and SEQ ID NO: 219.

In another preferred embodiment of the first aspect, which is also a preferred embodiment of the previous embodiments, the homology and/or identity of the amino acid sequence to SEQ ID NO: 202 is at least 75.0%, is at least 75.1%, is at least 75.2%, is at least 75.3%, is at least 75.4%, is at least 75.5%, is at least 75.6%, is at least 75.7%, is at least 75.8%, is at least 75.9%, 76.0%, is at least 76.1%, is at least 76.2%, is at least 76.3%, is at least 76.4%, is at least 76.5%, is at least 76.6%, is at least 76.7%, is at least 76.8%, is at least 76.9%, 77.0%, is at least 77.1%, is at least 77.2%, is at least 77.3%, is at least 77.4%, is at least 77.5%, is at least 77.6%, is at least 77.7%, is at least 77.8%, is at least 77.9%, 78.0%, is at least 78.1%, is at least 78.2%, is at least 78.3%, is at least 78.4%, is at least 78.5%, is at least 78.6%, is at least 78.7%, is at least 78.8%, is at least 78.9%, 79.0%, is at least 79.1%, is at least 79.2%, is at least 79.3%, is at least 79.4%, is at least 79.5%, is at least 79.6%, is at least 79.7%, is at least 79.8%, is at least 79.9%, is at least 80%, is at least 81%, is at least 82%, is at least 83%, is at least 84%, and preferably is at least 85%, or at least 86%, or at least 87%, or at least 88%, or at least 89%, and more preferably is at least 90%, or at least 91%, or at least 92%, or at least 93%, or at least 94%, or at least 95, and even more preferably at least 96%, or at least 97%, or at least 98%, and most preferably at least 99%, at least 99.1%, or at least 99.2%, or at least 99.3%, or at least 99.4%, or at least 99.5%, or at least 99.6%, or at least 99.7%, or at least 99.8%, and in particular at least 99.9%, or 100%.

In another preferred embodiment of the first aspect, which is also a preferred embodiment of all previous embodiments and preferred embodiments relating thereto, the at least one alpha-phosphorylase is a sucrose phosphorylase as defined in any of the previous embodiments above.

In another preferred embodiment of the first aspect, which is also a preferred embodiment of all previous embodiments relating thereto, the at least one glucose isomerase is a xylose isomerase derived from an organism belonging to any of the genera *Streptomyces, Actinomyces, Actinoplanes, Aeromonas, Arthrobacter, Bacillus, Bacteroides, Bifidobacterium, Brevibacterium, Burkholderia, Ciona, Citrobacter, Corynebacterium, Desemzia, Enterobacter, Escherichia, Geobacillus, Glutamicibacter, Gordonia, Hordeum, Lachnoclostridium, Lactobacillus, Leuconostoc, Microbacterium, Microbispora, Micromonospora, Mycobacterium, Nocardia, Nocardiopsis, Opuntia, Orpinomyces, Paenarthrobacter, Paraburkholderia, Paracolobacterium, Pectobacterium, Piromyces, Pseudonocardia, Saccharomyces, Sarcina, Scheffersomyces, Selenicereus, Sphingomonas, Streptococcus, Streptosporangium, Thermoanaerobacter, Thermoanaerobacterium, Thermopolyspora, Thermotoga, Thermus, Vibrio, Xanthomonas* or *Zymomonas*, more preferably belonging to any of the genera *Streptomyces, Actinoplanes, Arthrobacter, Geobacillus* or *Thermoanaerobacter*, most preferably belonging to the genus *Streptomyces*.

In the context of the present invention, preferably in the context of the first aspect including all preferred embodiments relating thereto, the glucose isomerase is a glucose isomerase variant with at least 95% sequence identity and/or sequence homology to an amino acid sequence of SEQ ID NO: 220, wherein the amino acid sequence of the glucose isomerase comprises an amino acid substitution at one or more amino acid positions, wherein the one or more amino acid positions is/are each and independently selected from the group consisting of SEQ ID NO: 220 amino acid positions 10, 33, 34, 35, 53, 59, 89, 90, and 95, preferably are selected from the group consisting of SEQ ID NO: 220 amino acid positions R10. A33, L34, D35, F53, I59, A89, T90, and 795.

In a preferred embodiment hereof, which is also a preferred embodiment of all previous embodiments, the glucose isomerase preferably comprises one or more substitutions, wherein the substitution is/are selected from the group consisting of an amino acid substitution at position R10 of SEQ ID NO: 220 with the substitution being R10H or R10K, preferably R10K;

an amino acid substitution at position A33 of SEQ ID NO: 220 with the substitution being A33I, A33L, A33V, A33G, A33N, A33M, A33C, A33S, A33Q or A33T, preferably A33I or A33N and most preferably A33I:

an amino acid substitution at position L34 of SEQ ID NO: 220 with the substitution being L34F, L34W, L34Y, or L34P, preferably L34F;

an amino acid substitution at position D35 of SEQ ID NO: 220 with the substitution being D35G, D35N, D35M, D35C, D35S, D35Q or D35T, preferably D35C or D35S, and more preferably D35S;

an amino acid substitution at position F53 of SEQ ID NO: 220 with the substitution being F53A, F53I, F53L, or F53V, preferably F53L;

an amino acid substitution at position I59 of SEQ ID NO: 220 with the substitution being I59F, I59W, I59Y or I59P, and preferably I59F;

an amino acid substitution at position A89 of SEQ ID NO: 220 with the substitution being A89I, A89L or A89V, and preferably A89V;

an amino acid substitution at position T90 of SEQ ID NO: 220 with the substitution being T90G, T90N, T90M, T90C, T90S or T90Q, and preferably T90S;

an amino acid substitution at position T95 of SEQ ID NO: 220 with the substitution being T95F, T95W, T95Y, T95P, T95R, T95H or 195K, preferably T95Y or T95R, and more preferably T95Y.

In a preferred embodiment of the first aspect, which is also a preferred embodiment of all embodiments related thereto, the glucose isomerase has at least one of the characteristics (I), (K), (L), and (M), or any combination thereof, wherein the characteristic
(I) is an increased activity of the glucose isomerase for the conversion of fructose to glucose at a concentration of 50 mM fructose in comparison to the glucose isomerase of SEQ ID NO: 220 of at least 1.1-fold up to 3.0-fold;
(K) is an increased activity of the glucose isomerase, for the conversion of fructose to glucose at a concentration of 200 mM fructose in comparison to the glucose isomerase of SEQ ID NO: 220 of at least 1.2-fold up to 3.0-fold;
(L) is thermal stability of glucose isomerase, expressed as residual activity after incubation of the glucose isomerase at a temperature of 74° C. for 15 minutes, wherein such residual activity is at least 30% up to 100%;
(M) is a $k_M$ value of the glucose isomerase of between 50 mM and 190 mM, and most preferably between 140 mM and 152 mM; and/or of less than 190 mM, and most preferably less than 155 mM, and utmost preferably of 152 mM.

Preferably, in the context of the present invention, preferably in the context of the first aspect including all preferred embodiments relating thereto, the glucose isomerase comprises or consists of an amino acid sequence selected from the group of sequences consisting of SEQ ID NO: 220 to SEQ ID NO: 240, preferably selected from the group of sequences consisting of SEQ ID NO: 221 to SEQ ID NO: 240, and more preferably selected from the group of sequences consisting of SEQ ID NO: 232 to SEQ ID NO: 240.

In another preferred embodiment of the first aspect, which is also a preferred embodiment of the previous embodiments, the homology and/or identity of the amino acid sequence to SEQ ID NO: 220 is at least 95%, or preferably at least 95.5%, or at least 96%, or at least 96.5%, or at least 97%, or at least 97.5%, or at least 98%, or at least 98.5%, or at least 99%, and most preferably of at least 99.1%, or at least 99.2%, or at least 99.3%, or at least 99.4%, or at least 99.5%, or at least 99.6%, or at least 99.7%, or at least 99.8%, and in particular at least 99.9%, or 100%.

In another preferred embodiment of the first aspect, which is also a preferred embodiment of all previous embodiments and preferred embodiments relating thereto, the at least one glucose isomerase is a glucose isomerase as defined in any of the previous embodiments above.

In another preferred embodiment of the first aspect, which is also a preferred embodiment of all previous embodiments and preferred embodiments relating thereto, the method of the invention is characterized in that
i) the at least one alpha-phosphorylase is in form of a sucrose phosphorylase comprising or consisting of an amino acid sequence selected from the group of sequences consisting of SEQ ID NO: SEQ ID NO: 202, SEQ ID NO: 203, SEQ ID NO: 204, SEQ ID NO: 205, SEQ ID NO: 206, SEQ ID NO: 207, SEQ ID NO: 208, SEQ ID NO: 209, SEQ ID NO: 210, SEQ ID NO: 211, SEQ ID NO: 212, SEQ ID NO: 213, SEQ ID NO: 214, SEQ ID NO: 215, SEQ ID NO: 216, SEQ ID NO: 217, SEQ ID NO: 218 and SEQ ID NO: 219, preferably selected from the group of sequences consisting of SEQ ID NO: 207, SEQ ID NO: 208, SEQ ID NO: 209, SEQ ID NO: 210, SEQ ID NO: 211, SEQ ID NO: 212, SEQ ID NO: 213, SEQ ID NO: 214, SEQ ID NO: 215, SEQ ID NO: 216, SEQ ID NO: 217, SEQ ID NO: 218 and SEQ ID NO: 219; and/or
(ii) the at least one trehalose phosphorylase is in form of a trehalose phosphorylase comprising or consisting of an amino acid sequence selected from the group of sequences consisting of SEQ ID NO: SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 150, SEQ ID NO: 151, SEQ ID NO: 152, SEQ ID NO: 153, SEQ ID NO: 154, SEQ ID NO: 155, SEQ ID NO: 156, SEQ ID NO: 157, SEQ ID NO: 158, SEQ ID NO: 159, SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197, SEQ ID NO: 198, SEQ ID NO: 199, SEQ ID NO: 200, SEQ ID NO: 201; and preferably selected from the group of sequences consisting of SEQ ID NO: SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 134. SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 150, SEQ ID NO: 151. SEQ ID NO: 152, SEQ ID NO: 153, SEQ ID NO: 154, SEQ ID NO: 155, SEQ ID NO: 156, SEQ ID NO: 157, SEQ ID NO: 158, SEQ ID NO: 159, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186. SEQ ID NO: 187, SEQ ID NO: 188, SEQ ID NO: 189, SEQ ID NO: 190; and/or iii) the at least one glucose isomerase is in form of a glucose isomerase comprising or consisting of an amino acid sequence selected from the group of sequences consisting of SEQ ID NO: 220 to SEQ ID NO: 240.

In another preferred embodiment, the method of the invention is characterized in that one or more of the enzyme(s) employed in the method is/are present in purified, partially purified, or non-purified formulation.

In the context of the present invention, the term "purified" generally means that the one or more enzyme(s) has/have been biochemically purified from any source of origin, preferably from any source of organism, preferably after its expression, more preferably after its recombinant expression within this organism, such that the enzyme is functionally and catalytically active to perform its designated catalytic reaction(s). Biochemical purification includes all methods known to the skilled person in the areas of protein chemistry, molecular biology and/or protein biochemistry, including, but not limited to, all means of using precipitation agents, incubation at an elevated temperature, liquid/solid separation to remove cell debris and nucleic acid from the liquid phase, microfiltration, centrifugation, high liquid ion exchange column chromatography, all means of affinity chromatography, batch purification, size-exclusion chromatography and alike.

In the context of the present invention, the term "partially purified" generally means that the one or more enzyme(s) has/have been biochemically purified from any source of origin, preferably from any source of organism, preferably after its expression within this organism, more preferably after its recombinant expression within this organism, by any kind of means or methods known to the skilled person and as described above, with the provision that the enzyme preparation may still contain further components and/or contaminants in addition to the enzyme of interest. It is to be understood that the term "partially purified" may refer to any kind of protein preparation containing or consisting of the enzyme or the enzymes of interest, wherein such protein preparation allows for the respective catalytic activity of each enzyme in order to enable the method of the present invention including all partial and/or subsequent reactions or conversions thereof.

In the context of the present invention, the term "non-purified" generally means any kind of protein preparation comprising the one or more enzyme(s) of interest of the present invention, wherein the enzyme or enzymes is/are derived from any source of origin, preferably from any source of organism, preferably after its expression within this organism, more preferably after its recombinant expression within this organism, and are not subject to specific purification routines. Non-purified enzymes in the context of this invention specifically mean enzyme preparation, wherein enzyme is expressed by a production host and either secreted by such host into the fermentation broth, or released from the production hosts by disrupting or lysing the host resulting in a crude lysate, and wherein such fermentation broth or crude lysate directly may serve as enzyme preparation. The enzyme preparations obtained may contain further components and/or contaminants in addition to the enzyme of interest. It is to be understood that the term "non-purified" may refer to any kind of protein preparation containing or consisting of the enzyme or the enzymes of interest, wherein such protein preparation allows for the respective catalytic activity of each enzyme in order to enable the method of the present invention including all partial and/or subsequent reactions or conversions thereof.

Preferably, the one or more of the enzyme(s) is/are either present in non-immobilized form or in immobilized form, preferably wherein the one or more enzyme(s) is/are immobilized on a carrier.

Preferably, suitable carriers for the immobilization of one or more enzymes of the invention are selected from the group consisting of any kind of chemical or biological matrix suitable of coupling and/or binding the one or more enzyme(s) of interest, preferably by means of adsorptive binding or covalent binding on functionalized polymeric resins, more preferably by electrostatic interaction, hydrophobic interaction, chemical linkers, cross-linking, entrapment into polymeric matrices, or by means of affinity binding.

In another preferred embodiment, which is also a preferred embodiment of all previous embodiments relating thereto, the one or more of the enzyme(s) is/are expressed from an expression element containing one or more nucleic acid sequence(s) encoding for either one, two, three, or even more individual recombinant proteins, which is suitable for expression of proteins coded by such nucleic acid sequence(s).

It is generally known to derive such nucleic acid molecule based on the amino acid sequences disclosed herein. Preferably, the nucleic acid sequence depends on the expression system used for the expression of the trehalose phosphorylase and/or for the expression of any of the enzyme(s) described herein. Expression elements for enzymes may be selected from expression elements such as recombinant plasmids, recombinant episomal expression vectors, yeast artificial chromosomes and recombinant genome-integrated nucleic acids elements which comprise or consists of the nucleic acid molecule encoding the enzymes of the invention. Preferred expression elements used for the expression of trehalose phosphorylase and/or for the expression of any of the enzyme(s) described herein are recombinant plasmids and recombinant genome-integrated nucleic acids elements which comprise or consists of the nucleic acid molecule encoding the enzymes of the invention and are introduced through transfection or genomic integration into preferred expression systems used for the expression of trehalose phosphorylase and/or for the expression of any of the enzyme(s) described herein. Preferred expression systems are *E. coli, Bacillus* sp, *P. pastoris* and fungal expression systems like *Aspergillus* sp.

In a still further embodiment, the present invention is related to a method, wherein a vector containing the nucleic acid molecule encoding the trehalose phosphorylase and/or for any of the enzyme(s) described herein is used. Preferably, the vector is an expression vector. Suitable vectors for the expression of enzymes have been described in the state of the art.

In a preferred embodiment, the present invention is related to a method for the expression of a trehalose phosphorylase and/or for any of the enzyme(s) described herein. Such method comprises cultivating a host organism disclosed in the description, wherein the host organism comprises an expression vector, wherein the expression vector comprises a nucleic acid molecule encoding a trehalose phosphorylase and/or for any of the enzyme(s) according to the present invention, under conditions which allow expression of said nucleic acid molecule, and harvesting the trehalose phosphorylase and/or for any of the enzyme(s) described herein.

In a still further embodiment, the present invention is related to a host organism containing the vector of the invention. Suitable hosts for hosts containing vectors for the expression of enzymes have been described, and preferably, the host organism is are *E. coli, Bacillus* sp. *P. pastoris* or a fungal expression system like *Aspergillus* sp., preferably *E. coli* and *P. pastoris*. Also known are methods to incorporate such vector into the host organism.

In this context, the one or more of the enzyme(s) is/are expressed in a host organism selected from the group consisting of yeast cells, plant cells, mammalian cells, insect cells, fungal cells and bacterial cells.

In the context of the present invention, the yeast cells may be derived from various species, including, but not limited to, *Saccharomyces cerevisiae, Schizosaccharomyces pombe, Yarrowia lipolytica, Candida glabrata, Ashbya gossypii, Cyberlindnera jadinii, Pichia pastoris, Kluyveromyces lactis, Hansenula polymorpha, Candida boidinii, Arxula adeninivorans, Xanthophyllomyces dendrorhous* or *Candida albicans* species, most preferably cells from the *Saccharomyces cerevisiae* species.

Further, fungal cell may derive from various species, including, but not limited to, filamentous fungi, any member belonging to the genera *Thermomyces, Acremonium, Aspergillus, Penicillium, Mucor, Neurospora, Trichoderma* and the like, while bacterial cells may be cells from species such as *E. coli* and *Bacillus subtilis*.

In a preferred embodiment of the invention, the one or more conversions of the method are performed and/or implemented in one or more of the host organisms described herein.

It is within the present invention that the trehalose phosphorylase and/or the one or more of the additional enzymes described and employed herein is/are present as full-length enzyme. It is also within the present invention that the trehalose phosphorylase and/or the one or more of the additional enzymes described and employed herein is/are present as a fragment. Preferably, the fragment retains trehalose phosphorylase and/or any other enzymatic activity described herein, preferably a trehalose phosphorylase activity as defined and, respectively disclosed herein.

In an embodiment of each and any aspect of the invention, including any embodiment thereof, the Tm50-value, and/or the residual activity at the given temperature and after given time, and/or process stability of any trehalose phosphorylase according to this disclosure is determined using the TP Assay I and/or TP Assay II as disclosed herein.

In an embodiment of each and any aspect of the invention, including any embodiment thereof, the Tm50-value, and/or the residual activity at the given temperature and after given time, of any sucrose phosphorylase according to this disclosure is determined using the SP Assay I and/or SP Assay II as disclosed herein.

In an embodiment of each and any aspect of the invention, including any embodiment thereof, the Tm50-value, and/or the residual activity at the given temperature and after given time, of any glucose isomerase according to this disclosure is determined using the GI Assay I and/or GI Assay II as disclosed herein.

It is to be understood that any of the enzymes, preferably the at least one trehalose phosphorylase, the at least one alpha-phosphorylase, and/or the at least one glucose isomerase of each and any aspect of the invention, including any embodiment thereof, is present in one of the following forms: a liquid solution, a dry powder, a freeze-dried powder, or in an immobilized form.

In embodiments of each and any aspect of the present invention, including any embodiment thereof, the following definitions apply.

Definition Homology: In the meaning of this invention, the homology is preferably calculated as identity using BLASSP (Stephen F. Altschul, Thomas L. Madden, Alejandro A. Schäffer, Jinghui Zhang, Zheng Zhang, Webb Miller, and David J. Lipman (1997) "Gapped BLAST and PSI-BLAST: a new generation of protein database search programs", Nucleic Acids Res. 25:3389-3402; Stephen F. Altschul. John C. Wootton. E. Michael Gertz, Richa Agarwala; Aleksandr Morgulis, Alejandro A. Schäffer, and Yi-Kuo Yu (2005) "Protein database searches using compositionally adjusted substitution matrices." FEBS J. 272:5101-5109), preferably using version BLASTP 2.2.29+(http://blast.ncbi.nlm.nih.gov/Blast.cgi), preferably using the following settings:
- Field "Enter Query Sequence": Query subrange: none
- Field "Choose Search Set": Database: non-redundant protein sequences (nr); optional parameters: none
- Field "Program Selection": Algorithm: blastp (protein-protein BLAST)
- Algorithm parameters: Field "General parameters": Max target sequences: 100: Short queries: Automatically adjust parameters for short input sequences; Expect threshold: 10; Word size: 3; Max matches in a query range: 0
- Algorithm parameters: Field "Scoring parameters": Matrix: BLOSUM62: Gap Costs: Existence: 11 Extension: 1; Compositional adjustments: Conditional compositional score matrix adjustment
- Algorithm parameters: Field "Filters and Masking": Filter: none: Mask: none. Results are filtered for sequences with more than 35% query coverage.

Definition thermal stability: For the purpose of the specification, thermal stability of an enzyme is the property of such enzyme to retain enzymatic activity upon incubation at elevated temperatures for a given time. The enzyme activity thereby can be determined at any assay conditions. For the purpose of this invention improvements in thermal stability of a certain enzyme were determined by measuring one or more of the following characteristics:

- Tm50-value: For the purpose of this invention, the Tm50-value is the temperature at which the enzyme possesses 50% of its initial activity after incubation for 15 min at this temperature in a suitable buffer. The initial activity is the activity of the respective enzyme without temperature treatment, i.e. with 15 min incubation at room temperature. The enzyme activity can be determined in principle by using any activity assay; for the purpose of this invention TP Assay I or II, SP Assay I or II or GI Assay I or II for the respective TP, SP, or GI enzymes have been used as described below and as specified in the examples. A suitable buffer, amongst others, for the measurement of Tm50-values is 50 mM potassium phosphate buffer pH 7, as specified in the examples. For the measurement of the Tm50 values of TP enzymes, the 50 mM potassium phosphate buffer pH 7 sometimes furthermore contained 1 M sucrose as specified in the examples.

- process stability/half-life: For the purpose of this invention; long-term stability was determined in suitable buffers and at suitable temperatures. The half-life is defined as the duration of time after which the enzyme possesses 50% of the activity at t=0 min. The enzyme activity can be determined in principle by using any activity assay: for the purpose of this invention TP Assay I or II, SP Assay I or II or GI Assay I or II for the respective TP, SP, or GI enzymes have been used as described below and as specified in the examples. A suitable buffer, amongst others, for the measurement of process stability is 50 mM potassium phosphate buffer pH 7, as specified in the examples. For the measurement of process stability of TP enzymes, the 50 mM potassium phosphate buffer pH 7 furthermore contained 1 M sucrose as specified in the examples.

- Residual activity after 15 min/52° C.: For the purpose of this invention, residual activity after 15 min/52° C. is defined as the activity of an enzyme after incubation for 15 min at 52° C. compared to its activity without incubation at 52° C. The residual activity is calculated by dividing the activity after incubation at 52° C. for 15 min by the activity without incubation at 52° C. and multiplying the value by 100 to obtain the residual activity value in percent. The enzyme activity can be determined in principle by using any activity assay. For the purpose of this invention TP Assay I or II, SP Assay I or II or GI Assay I or II have been used for the respective TP, SP, or GI enzymes as described below and as specified in the examples.

- Residual activity after 15 min/52.5° C.: For the purpose of this invention, residual activity after 15 min/52.5° C. is defined as the activity of an enzyme after incubation for 15 min at 52.5° C. compared to its activity without incubation at 52.5° C. The residual activity is calculated by dividing the activity after incubation at 52.5° C. for 15 min by the activity without incubation at 52.5° C. and multiplying the value by 100 to obtain the residual activity value in percent. The enzyme activity can be determined in principle by using any activity assay. For the purpose of this invention TP Assay I or II, SP Assay I or II or GI Assay I or II for the respective TP, SP, or GI enzymes have been used as described below and as specified in the examples.

- Residual activity after 15 min/70° C.: For the purpose of this invention, residual activity after 15 min/70° C. is defined as the activity of an enzyme after incubation for 15 min at 70° C. compared to its activity without incubation at 70° C. The residual activity is calculated by dividing the activity after incubation at 70° C. for 15 min by the activity without incubation at 70° C. and multiplying the value by 100 to obtain the residual activity value in percent. The enzyme activity can be determined in principle by using any activity assay. For the purpose of this invention TP Assay I or II, SP Assay I or II or GI Assay I or II for the respective TP, SP, or GI enzymes have been used as described below and as specified in the examples.

Definition of Productivity per kU TP enzyme: The Productivity of a trehalose phosphorylase (TP) per kU TP enzyme is calculated by dividing the amount of trehalose per Liter reaction volume produced in a two-enzyme process or three-enzyme process from saccharide raw material, respectively by the reaction time and the amount of TP enzyme catalytic activity added to the reaction in kU. TP Units are determined by standard enzymatic assays known in the art. TP Units may be determined by using the TP Assay I as outlined in the context of the present invention, characterized in that the amount of trehalose is given as gram trehalose dehydrate per Liter, and the reaction time is expressed in hours. The Productivity per kU trehalose phosphorylase according to the method of the invention is or may be determined at any time during the enzymatic conversion until up to the time of completion of the reaction, where no more trehalose product is formed by enzymatic conversion.

Saccharide raw material may be sucrose or starch, and preferably is sucrose. In the event that the method is performed in separate sequential steps, the Productivity per kU TP is or may be determined for the step which comprises the trehalose phosphorylase enzyme as part of the reaction; the substrate for the enzymatic conversion of such separate step then is the aG1P intermediate obtained from saccharide raw material in any previous step(s).

Definition of phosphorolysis activity and synthesis activity of TP enzymes: As TPs catalyze the reversible phosphorolytic cleavage of trehalose, activity can be determined either in the direction of trehalose phosphorolysis or synthesis. For the purpose of this invention, phosphorolysis activity is defined as the activity for trehalose cleavage in the presence of inorganic phosphate to aG1P and glucose at the conditions described below as TP Assay I. Synthesis activity is defined as the activity for trehalose synthesis from aG1P and glucose at the conditions described below as TP Assay II. It is within the present invention that any activity and any activity of the trehalose phosphorylase is in an embodiment a catalytic activity.

Definition of TP Assay I: Phosphorolytic activity was routinely assayed at 30° C. using a continuous coupled assay in which the aG1P produced from trehalose is converted to glucose-6-phosphate by phosphoglucomutase. Glucose-6-phosphate and NADP is converted to 6-phospho-gluconate and NADPH by glucose 6-phosphate dehydrogenase. The detection is based on measuring the absorbance of NADPH at 340 nm. The assay solution contained: 75 mM potassium phosphate buffer pH 7. 2.5 mM NADP, 10 μM glucose 1,6-bisphosphate, 10 mM $MgCl_2$, 225 mM trehalose, 3 U/mL phosphoglucomutase and 3.4 U/mL glucose 6-phosphate dehydrogenase.

Definition of TP Assay II: Synthetic activity was routinely assayed at 40° C. using the following conditions: 50 mM sodium MES buffer pH 7, 100 mM aG1P and 100 or 500 mM glucose concentrations as given. Reaction progress was determined discontinuously by measuring liberated phosphate with an assay based on the complex formation with molybdate under acidic conditions. The molybdate complex is reduced by ferrous sulfate and yields a blue color, which is analyzed photometrically at 750 nm. For the analysis 250 μL of sample are mixed with 250 μL 0.5 M HCl and 500 μL molybdate-reagent (73.2 g/L $Fe(II)SO_4 \cdot 7H_2O$ and 10 g/L ammonium molybdate$\cdot 4H_2O$ in 3.5% sulfuric acid). After incubation at room temperature (RT) for 15-30 min, absorbance is measured at 750 nm. The amount of inorganic phosphate in the sample is quantified using external standards.

Definition of phosphorolysis activity of SP enzymes: For the purpose of this invention, phosphorolytic activity of a sucrose phosphorylase is defined as the activity for phosphorolytic sucrose cleavage to aG1P and fructose. Phosphorolytic activity of a sucrose phosphorylase was routinely assayed using SP Assay I or SP Assay II as described below and specified in the examples.

Definition of hydrolytic activity of SP enzymes: For the purpose of this invention, hydrolytic activity of a sucrose phosphorylase is defined as the activity for hydrolytic aG1P cleavage to glucose and inorganic phosphate using SP Assay III as described below.

Definition of SP Assay I: SP Assay I comprises using a continuous coupled assay at 30° C. in which the aG1P produced from sucrose substrate is converted to glucose-6-phosphate by phosphoglucomutase. Glucose-6-phosphate and NADP is converted to 6-phospho-gluconate and NADPH by glucose 6-phosphate dehydrogenase. The detection is based on measuring the absorbance of NADPH at 340 nm. The assay solution contained: 75 mM potassium phosphate buffer pH 7, 2.5 mM NADP, 10 μM glucose 1,6-bisphosphate, 10 mM $MgCl_2$, 250 mM sucrose, 3 U/mL phosphoglucomutase and 3.4 U/mL glucose 6-phosphate dehydrogenase. 1 U is defined as the amount of enzyme that catalyzes the production of 1 μmol of aG1P at the specified conditions.

Definition of SP Assay II: Alternatively, phosphorolytic activity can be determined in an uncoupled assay as described. In brief, sucrose phosphorylase is incubated at 30° C. in the presence of 500 mM sucrose and 200 mM potassium phosphate buffer pH 7. At discrete time-points, 20 μl samples were taken and inactivated by the addition of 80 μL 0.25 M HCl. Samples were neutralized and the aG1P-concentration determined. For the determination of aG1P concentration, a 10 μL sample was added to 90 μL detection reagent containing 48 mM potassium phosphate buffer, 2 mM $MgCl_2$, 0.7 mM NADP, 3.8 mM glucose 6-phosphate dehydrogenase and 3.3 U/mL phosphoglucomutase. After incubation for 20 min at room temperature, the absorbance at 340 nm was determined. The amount of aG1P was quantified with an aG1P calibration curve derived from samples with known amounts of aG1P. 1 U is defined as the amount of enzyme that catalyzes the production of 1 μmol of aG1P at the specified conditions.

Definition of SP Assay III: Hydrolytic activity of a sucrose phosphorylase was determined by adding to a solution containing 100 mM aG1P and 50 mM 2-(N-morpholino)ethanesulfonic acid-buffer pH 7 and incubated at 30° C. At discrete time-points, 100 μl samples were taken and inactivated by the addition of 200 μL 1 M HCl. Samples were neutralized and the aG1P-concentration determined as described in Example 1. In short, a 10 μL sample was added to 90 μL detection reagent containing 48 mM potassium phosphate buffer, 2 mM MgCl2, 0.7 mM NADP, 3.8 mM glucose 6-phosphate dehydrogenase and 3.3 U/mL phosphoglucomutase. After incubation for 20 min at room temperature, the absorbance at 340 nm was determined. The amount of aG1P was quantified with an aG1P calibration curve derived from samples with known amounts of aG1P. Hydrolytic activity was calculated from the initial slope by linear regression of aG1P-concentration over time. 1 U is defined as the amount of enzyme that catalyzes the hydrolytic cleavage of 1 μmol of aG1P per min at the specified conditions. If the sucrose phosphorylase was derived from a non-purified cell free extract, a heat purification step was performed in order to remove the aG1P-degrading activity of the host background. Therefor cell extract was incubated at 55° C. for 15 min. The heat-purified cell free extract containing soluble enzyme was separated from the debris by centrifugation. A decrease in hydrolytic activity of a sucrose phosphorylase of a wild-type enzyme or a variant thereof compared to another wild-type enzyme is indicative of a greater stability of aG1P in a reaction resulting from an inherent enzyme characteristic.

Definition of GI Assay I: Glucose isomerase activity was assayed by monitoring the formation of glucose from fructose at 40° C. using the following conditions: 50 mM potassium phosphate buffer pH 7, 10 $Mg^{2+}$ (as $MgCl_2$ or $MgSO_4$), 0.2 mL/mL reaction glucose isomerase enzyme preparations (diluted in 50 mM potassium phosphate buffer pH 7 so as to reach a maximum yield of 18%) and 50 or 200 mM fructose concentrations as given. The glucose produced from fructose by the action of glucose isomerase was determined using a discontinuous coupled assay in which the glucose is converted to glucose-6-phosphate by hexokinase. Glucose-6-phosphate and NADP is converted to 6-phospho-gluconate and NADPH by glucose 6-phosphate dehydrogenase. The detection is based on measuring the absorbance of NADPH at 340 nm. The D-GLUCOSE HK kit (HK/G6P-DH Format) was employed in the microplate format (product no. K-GLUHK-110A or K-GLUHK-220A available from Megazyme International Ireland, Wicklow, Ireland). The assay is performed according to the manufacturer recommendations and the amount of glucose in the sample is quantified using external standards.

Definition of GI Assay II: The reaction for measuring glucose isomerase activity was conducted by monitoring the formation of glucose from fructose at following conditions:

50 mM potassium phosphate buffer pH 7, 10 mM MgSO$_4$. 0.05 mL/mL reaction glucose isomerase enzyme preparations (diluted in 50 mM potassium phosphate buffer pH 7 so as to reach a maximum yield of 18%), 50-1000 mM fructose concentrations, and 40° C. The reaction was quenched by adding 0.1 mL 0.25 M HCl per mL reaction. The glucose produced from fructose by the action of glucose isomerase was determined using a discontinuous coupled assay in which glucose was converted to gluconolactone by glucose oxidase, Hydrogen peroxide, a by-product of this reaction, was used by horseradish peroxidase to oxidize 2,2'-azino-bis(3-ethylbenzothiazoline-6-sulphonic acid (ABTS), yielding a coloured product, which shows absorbance at 405 nm. A 10 µL aliquot of acid-quenched reaction is mixed with 90 µL of the assay mix containing 50 mM potassium phosphate buffer pH 6. 1 mM ABTS, 5 U/mL glucose oxidase and 1 U/mL horseradish peroxidase. After 60-70 min incubation at 30° C., the absorbance at 405 nm was measured (endpoint measurement). The amount of glucose in the sample is quantified using external standards.

Definition PM-ratio: The P/H-ratio of a sucrose phosphorylase is the ratio between the phosphorolytic and hydrolytic activity of the respective sucrose phosphorylase. It is calculated by dividing the phosphorolytic activity determined using SP Assay I of such sucrose phosphorylase by the hydrolytic activity determined using SP Assay III of the same sucrose phosphorylase and multiplying the value by 100 to obtain the P/H-ratio for such sucrose phosphorylase in percent.

aG1P formation: For the purpose of this invention, the efficiency of a sucrose phosphorylases in alpha-D-glucose 1-phosphate (aG1P) formation at high concentrations of the substrate sucrose was tested by incubation of 20 U of each heat-purified sucrose phosphorylase in a solution containing 1 M sucrose and 1 phosphate buffer pH 7 at 30° C. for 24 h, and subsequent quantification of the aG1P concentration of the reaction mixture. The aG1P concentration was determined by adding a 10 µL sample to 90 µL detection reagent containing 48 mM potassium phosphate buffer, 2 mM MgCl2, 0.7 mM NADP, 3.8 mM glucose 6-phosphate dehydrogenase and 3.3 U/mL phosphoglucomutase. After incubation for 20 min at room temperature, the absorbance at 340 nm was determined. The amount of aG1P was quantified with an aG1P calibration curve derived f samples with known amounts of aG1P.

Figure 2:
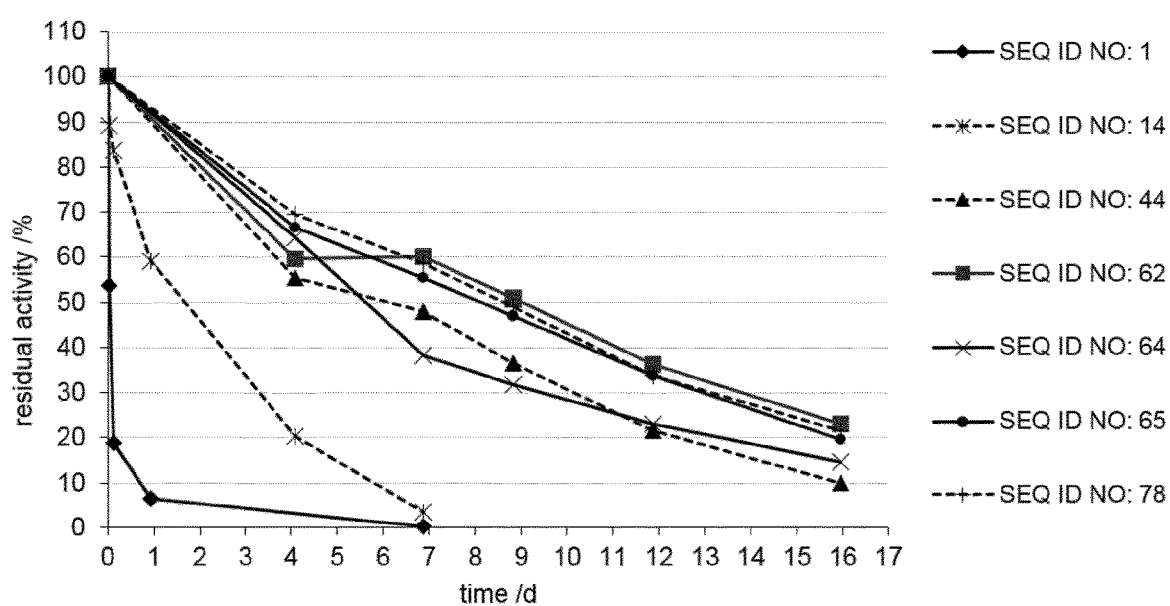

In an embodiment, if not indicated to the contrary any activity, enzymatic activity, phosphorolysis activity and synthesis activity displayed or to be displayed by the polypeptide, or by the trehalose phosphorylase variant, and, preferably any trehalose phosphorylase of the pre nt invention is defined and, respectively, determined by the methods and assays, respectively, disclosed herein. The present invention is further illustrated by the figures, examples, tables and the sequence listing from which further features, embodiments and advantages may be taken, wherein:

FIG. 1 is a diagram showing residual activity in % as a function of temperature for wild type trehalose phosphorylase of SEQ ID NO: 1 in the presence and in the absence of 1M sucrose added a stabilizing agent; and FIG. 2 is a diagram is a diagram showing residual activity in % as a function of time for wild type trehalose phosphorylase of SEQ ID NO: 1 and various trehalose phosphorylases of the invention.

TABLE 1

Overview over Sequence IDs.

| SEQ ID | Source | No of mutations | Mutations (numbering refers to reference sequence specified column 2) |
|---|---|---|---|
| SEQ ID NO: 1 | wild type, *Schizophyllum commune*, GenBank: ABC84380.1 | None | none |
| SEQ ID NO: 2 | variant of SEQ ID NO: 1 | 1 | K705N |
| SEQ ID NO: 3 | variant of SEQ ID NO: 1 | 2 | P383S, L712M |
| SEQ ID NO: 4 | variant of SEQ ID NO: 1 | 2 | K705N, L712M |
| SEQ ID NO: 5 | variant of SEQ ID NO: 1 | 3 | V10R, A506S, L712M |
| SEQ ID NO: 6 | variant of SEQ ID NO: 1 | 4 | V10R, Y220F, A506S, L712M |
| SEQ ID NO: 7 | variant of SEQ ID NO: 1 | 4 | V10R, L114I, Y220F, L712M |
| SEQ ID NO: 8 | variant of SEQ ID NO: 1 | 4 | Y220F, A506S, K705N, L712M |
| SEQ ID NO: 9 | variant of SEQ ID NO: 1 | 6 | V10R, L114I, Y220F, A506S, K705N, L712M |
| SEQ ID NO: 10 | variant of SEQ ID NO: 1 | 2 | P383V, L712M |
| SEQ ID NO: 11 | variant of SEQ ID NO: 1 | 8 | L114I, I118V, P383V, Q476G, K488A, A506S, A511S, L712M |
| SEQ ID NO: 12 | variant of SEQ ID NO: 1 | 9 | L114I, I118V, A304I, F349Y, G357A, P383V, A506S, A511S, L712M |
| SEQ ID NO: 13 | variant of SEQ ID NO: 1 | 7 | L114I, I118V, A304I, F349Y, P383V, E481I, L712M |
| SEQ ID NO: 14 | variant of SEQ ID NO: 1 | 6 | L114I, I118V, A304I, G357A, P383V, L712M |
| SEQ ID NO: 15 | variant of SEQ ID NO: 1 | 8 | L114I, I118V, F349Y, G357A, P383V, E481I, K488A, L712M |
| SEQ ID NO: 16 | variant of SEQ ID NO: 1 | 8 | L114I, I118V, A304I,P383V, E481I, A506S, A511S, L712M |
| SEQ ID NO: 17 | variant of SEQ ID NO: 1 | 7 | L114I, I118V, P383V, K488A, A506S, A511S, L712M |
| SEQ ID NO: 18 | variant of SEQ ID NO: 1 | 9 | L114I, I118V, A304I, G357A, P383V, K488A, A506S A511S, L712M |
| SEQ ID NO: 19 | variant of SEQ ID NO: 1 | 5 | L114I, I118V, P383V, E481I, L712M |

TABLE 1-continued

Overview over Sequence IDs.

| SEQ ID | Source | No of mutations | Mutations (numbering refers to reference sequence specified column 2) |
|---|---|---|---|
| SEQ ID NO: 20 | variant of SEQ ID NO: 1 | 7 | L114I, I118V, A304I, F349Y, P383V, K488A, L712M |
| SEQ ID NO: 21 | variant of SEQ ID NO: 1 | 7 | L114I, I118V, P383V, E481I, A506S, A511S, L712M |
| SEQ ID NO: 22 | variant of SEQ ID NO: 1 | 7 | L114I, I118V, S192V, A304I, G357A, P383V, L712M |
| SEQ ID NO: 23 | variant of SEQ ID NO: 1 | 7 | L114I, I118V, S197G, A304I, G357A, P383V, L712M |
| SEQ ID NO: 24 | variant of SEQ ID NO: 1 | 7 | L114I, I118V, N225V, A304I, G357A, P383V, L712M |
| SEQ ID NO: 25 | variant of SEQ ID NO: 1 | 7 | L114I, I118V, A304I, D306H, G357A, P383V, L712M |
| SEQ ID NO: 26 | variant of SEQ ID NO: 1 | 7 | L114I, I118V, A304I, P318H, G357A, P383V, L712M |
| SEQ ID NO: 27 | variant of SEQ ID NO: 1 | 7 | L114I, I118V, A304I, T323I, G357A, P383V, L712M |
| SEQ ID NO: 28 | variant of SEQ ID NO: 1 | 7 | L114I, I118V, A304I, L339I, G357A, P383V, L712M |
| SEQ ID NO: 29 | variant of SEQ ID NO: 1 | 7 | L114I, I118V, A304I, F349Y, G357A, P383V, L712M |
| SEQ ID NO: 30 | variant of SEQ ID NO: 1 | 7 | L114I, I118V, A304I, G357A, P383V, A459S, L712M |
| SEQ ID NO: 31 | variant of SEQ ID NO: 1 | 7 | L114I, I118V, A304I, G357A, P383V, E481I, L712M |
| SEQ ID NO: 32 | variant of SEQ ID NO: 1 | 7 | L114I, I118V, A304I, G357A, P383V, A484S, L712M |
| SEQ ID NO: 33 | variant of SEQ ID NO: 1 | 7 | L114I, I118V, A304I, G357A, P383V, Q487V, L712M |
| SEQ ID NO: 34 | variant of SEQ ID NO: 1 | 7 | L114I, I118V, A304I, G357A, P383V, Q487A, L712M |
| SEQ ID NO: 35 | variant of SEQ ID NO: 1 | 7 | L114I, I118V, A304I, G357A, P383V, Q487L, L712M |
| SEQ ID NO: 36 | variant of SEQ ID NO: 1 | 7 | L114I, I118V, A304I, G357A, P383V, R526E, L712M |
| SEQ ID NO: 37 | variant of SEQ ID NO: 1 | 7 | L114I, I118V, A304I, G357A, P383V, E530V, L712M |
| SEQ ID NO: 38 | variant of SEQ ID NO: 1 | 7 | L114I, I118V, A304I, G357A, P383V, G532R, L712M |
| SEQ ID NO: 39 | variant of SEQ ID NO: 1 | 7 | L114I, I118V, A304I, G357A, P383V, D533G, L712M |
| SEQ ID NO: 40 | variant of SEQ ID NO: 1 | 7 | L114I, I118V, A304I, G357A, P383V, D537M, L712M |
| SEQ ID NO: 41 | variant of SEQ ID NO: 1 | 7 | L114I, I118V, A304I, G357A, P383V, V550I, L712M |
| SEQ ID NO: 42 | variant of SEQ ID NO: 1 | 7 | L114I, I118V, A304I, G357A, P383V, S556T, L712M |
| SEQ ID NO: 43 | variant of SEQ ID NO: 1 | 7 | L114I, I118V, A304I, G357A, P383V, T564E, L712M |
| SEQ ID NO: 44 | variant of SEQ ID NO: 1 | 7 | L114I, I118V, A304I, G357A, P383V, D590N, L712M |
| SEQ ID NO: 45 | variant of SEQ ID NO: 1 | 7 | L114I, I118V, A304I, G357A, P383V, D590A, L712M |
| SEQ ID NO: 46 | variant of SEQ ID NO: 1 | 7 | L114I, I118V, A304I, G357A, P383V, A649E, L712M |
| SEQ ID NO: 47 | variant of SEQ ID NO: 1 | 7 | L114I, I118V, A304I, G357A, P383V, R667E, L712M |
| SEQ ID NO: 48 | variant of SEQ ID NO: 1 | 7 | L114I, I118V, A304I, G357A, P383V, R667K, L712M |
| SEQ ID NO: 49 | variant of SEQ ID NO: 1 | 7 | L114I, I118V, A304I, G357A, P383V, A703E, L712M |
| SEQ ID NO: 50 | variant of SEQ ID NO: 1 | 9 | L114I, I118V, A304I, G357A, P383V, V550I, S556T, D590N, L712M |
| SEQ ID NO: 51 | variant of SEQ ID NO: 1 | 10 | L114I, I118V, N225V, A304I, G357A, P383V, Q487L, T564E, D590N, L712M |
| SEQ ID NO: 52 | variant of SEQ ID NO: 1 | 10 | L114I, I118V, A304I, T323I, G357A, P383V, V550I, T564E, D590N, L712M |
| SEQ ID NO: 53 | variant of SEQ ID NO: 1 | 10 | L114I, I118V, N225V, A304I, T323I, G357A, P383V, Q487L, D590N, L712M |

TABLE 1-continued

Overview over Sequence IDs.

| SEQ ID | Source | No of mutations | Mutations (numbering refers to reference sequence specified column 2) |
|---|---|---|---|
| SEQ ID NO: 54 | variant of SEQ ID NO: 1 | 11 | L114I, I118V, N225V, A304I, G357A, P383V, Q487L, V550I, S556T, D590N, L712M |
| SEQ ID NO: 55 | variant of SEQ ID NO: 1 | 11 | L114I, I118V, N225V, A304I, G357A, P383V, Q487L, V550I, T564E, D590N, L712M |
| SEQ ID NO: 56 | variant of SEQ ID NO: 1 | 11 | L114I, I118V, N225V, A304I, G357A, P383V, V550I, S556T, T564E, D590N, L712M |
| SEQ ID NO: 57 | variant of SEQ ID NO: 1 | 11 | L114I, I118V, N225V, A304I, G357A, P383V, V550I, T564E, D590N, A649E, L712M |
| SEQ ID NO: 58 | variant of SEQ ID NO: 1 | 11 | L114I, I118V, A304I, T323I, G357A, P383V, V550I, S556T, T564E, D590N, L712M |
| SEQ ID NO: 59 | variant of SEQ ID NO: 1 | 11 | L114I, I118V, A304I, T323I, G357A, P383V, Q487L, V550I, D590N, A649E, L712M |
| SEQ ID NO: 60 | variant of SEQ ID NO: 1 | 12 | L114I, I118V, N225V, A304I, G357A, P383V, Q487A, V550I, S556T, T564E, D590N, L712M |
| SEQ ID NO: 61 | variant of SEQ ID NO: 1 | 12 | L114I, I118V, N225V, A304I, G357A, P383V, V550I, S556T, T564E, D590N, A649E, L712M |
| SEQ ID NO: 62 | variant of SEQ ID NO: 1 | 12 | L114I, I118V, N225V, A304I, T323I, G357A, P383V, Q487L, V550I, T564E, D590N, L712M |
| SEQ ID NO: 63 | variant of SEQ ID NO: 1 | 12 | L114I, I118V, N225V, A304I, T323I, G357A, P383V, Q487L, V550I, D590N, A649E, L712M |
| SEQ ID NO: 64 | variant of SEQ ID NO: 1 | 12 | L114I, I118V, N225V, A304I, T323I, G357A, P383V, Q487A, V550I, S556T, V590N, L712M |
| SEQ ID NO: 65 | variant of SEQ ID NO: 1 | 12 | L114I, I118V, N225V, A304I, T323I, G357A, P383V, V550I, S556T, T564E, D590N, L712M |
| SEQ ID NO: 66 | variant of SEQ ID NO: 1 | 12 | L114I, I118V, A304I, T323I, F349Y, G357A, P383V, Q487L, V550I, D590N, A649E, L712M |
| SEQ ID NO: 67 | variant of SEQ ID NO: 1 | 12 | L114I, I118V, A304I, T323I, G357A, P383V, Q487A, V550I, S556T, T564E, D590N, L712M |
| SEQ ID NO: 68 | variant of SEQ ID NO: 1 | 12 | L114I, I118V, A304I, G357A, P383V, Q487A, V550I, S556T, T564E, D590N, A649E, L712M |
| SEQ ID NO: 69 | variant of SEQ ID NO: 1 | 12 | L114I, I118V, A304I, G357A, P383V, Q487L, V550I, S556T, T564E, D590N, A649E, L712M |
| SEQ ID NO: 70 | variant of SEQ ID NO: 1 | 13 | L114I, I118V, N225V, A304I, T323I, F349Y, G357A, P383V, V550I, S556T, D590N, A649E, L712M |
| SEQ ID NO: 71 | variant of SEQ ID NO: 1 | 13 | L114I, I118V, N225V, A304I, T323I, G357A, P383V, Q487L, V550I, S556T, D590N, A649E, L712M |
| SEQ ID NO: 72 | variant of SEQ ID NO: 1 | 13 | L114I, I118V, N225V, A304I, F349Y, G357A, P383V, Q487A, V550I, S556T, T564E, D590N, L712M |
| SEQ ID NO: 73 | variant of SEQ ID NO: 1 | 13 | L114I, I118V, N225V, A304I, F349Y, G357A, P383V, Q487L, V550I, T564E, D590N, A649E, L712M |
| SEQ ID NO: 74 | variant of SEQ ID NO: 1 | 13 | L114I, I118V, N225V, A304I, G357A, P383V, Q487L, V550I, S556T, T564E, D590N, A649E, L712M |
| SEQ ID NO: 75 | variant of SEQ ID NO: 1 | 13 | L114I, I118V, N225V, A304I, G357A, P383V, Q487A, V550I, S556T, T564E, D590N, A649E, L712M |

TABLE 1-continued

Overview over Sequence IDs.

| SEQ ID | Source | No of mutations | Mutations (numbering refers to reference sequence specified column 2) |
|---|---|---|---|
| SEQ ID NO: 76 | variant of SEQ ID NO: 1 | 13 | L114I, I118V, A304I, T323I, G357A, P383V, Q487L, V550I, S556T, T564E, D590N, A649E, L712M |
| SEQ ID NO: 77 | variant of SEQ ID NO: 1 | 13 | L114I, I118V, A304I, T323I G357A, P383V, Q487L, V550I, S556T, T564E, D590N, A649E, L712M |
| SEQ ID NO: 78 | variant of SEQ ID NO: 1 | 14 | L114I, I118V, N225V, A304I, T323I, G357A, P383V, Q487A, V550I, S556T, T564E, D590N, A649E, L712M |
| SEQ ID NO: 79 | variant of SEQ ID NO: 1 | 14 | L114I, I118V, N225V, A304I, T323I, G357A, P383V, Q487G, V550I, S556T, T564E, D590N, A649E, L712M |
| SEQ ID NO: 80 | wild type, *Hypholoma sublateritium* FD-334 SS-4, Genbank: KJA27491.1 | none | none |
| SEQ ID NO: 81 | wild type, *Grifoia frondosa*, Genbank: ADM15725 | none | none |
| SEQ ID NO: 82 | wild type, *Pleurotus ostreatus*, Genbank: KDQ33172.1 | none | none |
| SEQ ID NO: 83 | wild type, *Lentinus sajor-caju*, UniProtKB/Swiss-Prot: Q9UV63.1 | none | none |
| SEQ ID NO: 84 | variant of SEQ ID NO: 1 | 1 | N225V |
| SEQ ID NO: 85 | variant of SEQ ID NO: 1 | 1 | A304I |
| SEQ ID NO: 86 | variant of SEQ ID NO: 1 | 1 | T323I |
| SEQ ID NO: 87 | variant of SEQ ID NO: 1 | 1 | P383V |
| SEQ ID NO: 88 | variant of SEQ ID NO: 1 | 1 | Q487A |
| SEQ ID NO: 89 | variant of SEQ ID NO: 1 | 1 | S556T |
| SEQ ID NO: 90 | variant of SEQ ID NO: 1 | 1 | T564E |
| SEQ ID NO: 91 | variant of SEQ ID NO: 1 | 1 | D590N |
| SEQ ID NO: 92 | variant of SEQ ID NO: 1 | 1 | N225I |
| SEQ ID NO: 93 | variant of SEQ ID NO: 1 | 1 | N225L |
| SEQ ID NO: 94 | variant of SEQ ID NO: 1 | 1 | N225M |
| SEQ ID NO: 95 | variant of SEQ ID NO: 1 | 1 | A304L |
| SEQ ID NO: 96 | variant of SEQ ID NO: 1 | 1 | T323V |
| SEQ ID NO: 97 | variant of SEQ ID NO: 1 | 1 | P383A |
| SEQ ID NO: 98 | variant of SEQ ID NO: 1 | 1 | P383G |
| SEQ ID NO: 99 | variant of SEQ ID NO: 1 | 1 | P383M |
| SEQ ID NO: 100 | variant of SEQ ID NO: 1 | 1 | P383N |
| SEQ ID NO: 101 | variant of SEQ ID NO: 1 | 1 | P383C |
| SEQ ID NO: 102 | variant of SEQ ID NO: 1 | 1 | P383Q |
| SEQ ID NO: 103 | variant of SEQ ID NO: 1 | 1 | P383S |
| SEQ ID NO: 104 | variant of SEQ ID NO: 1 | 1 | P383T |
| SEQ ID NO: 105 | variant of SEQ ID NO: 1 | 1 | Q487G |
| SEQ ID NO: 106 | variant of SEQ ID NO: 1 | 1 | Q487L |
| SEQ ID NO: 107 | variant of SEQ ID NO: 1 | 1 | Q487M |
| SEQ ID NO: 108 | variant of SEQ ID NO: 1 | 1 | V550P |
| SEQ ID NO: 109 | variant of SEQ ID NO: 1 | 1 | D590G |
| SEQ ID NO: 110 | variant of SEQ ID NO: 1 | 2 | I118V, P383V |
| SEQ ID NO: 111 | variant of SEQ ID NO: 1 | 2 | I118V, S556T |
| SEQ ID NO: 112 | variant of SEQ ID NO: 1 | 2 | I118V, T564E |
| SEQ ID NO: 113 | variant of SEQ ID NO: 1 | 2 | I118V, D590N |
| SEQ ID NO: 114 | variant of SEQ ID NO: 1 | 2 | N225V, A304I |
| SEQ ID NO: 115 | variant of SEQ ID NO: 1 | 2 | N225V, P383V |
| SEQ ID NO: 116 | variant of SEQ ID NO: 1 | 2 | N225V, Q487A |
| SEQ ID NO: 117 | vanant of SEQ ID NO: 1 | 2 | N225V, V550I |
| SEQ ID NO: 118 | variant of SEQ ID NO: 1 | 2 | N225V, S556T |
| SEQ ID NO: 119 | variant of SEQ ID NO: 1 | 2 | N225V, S590N |
| SEQ ID NO: 120 | variant of SEQ ID NO: 1 | 2 | A304I, T323I |
| SEQ ID NO: 121 | variant of SEQ ID NO: 1 | 2 | A304I, P383V |
| SEQ ID NO: 122 | variant of SEQ ID NO: 1 | 2 | A304I, Q487A |
| SEQ ID NO: 123 | variant of SEQ ID NO: 1 | 2 | A304I, S556T |
| SEQ ID NO: 124 | variant of SEQ ID NO: 1 | 2 | A304I, T564E |
| SEQ ID NO: 125 | variant of SEQ ID NO: 1 | 2 | A304I, D590N |
| SEQ ID NO: 126 | variant of SEQ ID NO: 1 | 2 | T323I, G357A |
| SEQ ID NO: 127 | variant of SEQ ID NO: 1 | 2 | T323I, Q487A |
| SEQ ID NO: 128 | variant of SEQ ID NO: 1 | 2 | T323I, S556T |
| SEQ ID NO: 129 | variant of SEQ ID NO: 1 | 2 | T323I, T564E |
| SEQ ID NO: 130 | variant of SEQ ID NO: 1 | 2 | T323I, D590N |

TABLE 1-continued

Overview over Sequence IDs.

| SEQ ID | Source | No of mutations | Mutations (numbering refers to reference sequence specified column 2) |
|---|---|---|---|
| SEQ ID NO: 131 | variant of SEQ ID NO: 1 | 2 | T323I, A649E |
| SEQ ID NO: 132 | variant of SEQ ID NO: 1 | 2 | F349Y, P383V |
| SEQ ID NO: 133 | variant of SEQ ID NO: 1 | 2 | F349Y, D590N |
| SEQ ID NO: 134 | variant of SEQ ID NO: 1 | 2 | G357A, P383V |
| SEQ ID NO: 135 | variant of SEQ ID NO: 1 | 2 | G357A, D590N |
| SEQ ID NO: 136 | variant of SEQ ID NO: 1 | 2 | P383V, Q487A |
| SEQ ID NO: 137 | variant of SEQ ID NO: 1 | 2 | P383V, V550I |
| SEQ ID NO: 138 | variant of SEQ ID NO: 1 | 2 | P383V, S556T |
| SEQ ID NO: 139 | variant of SEQ ID NO: 1 | 2 | P383V, T564E |
| SEQ ID NO: 140 | variant of SEQ ID NO: 1 | 2 | P383V, D590N |
| SEQ ID NO: 141 | variant of SEQ ID NO: 1 | 2 | P383V, A649E |
| SEQ ID NO: 142 | variant of SEQ ID NO: 1 | 2 | Q487A, T564E |
| SEQ ID NO: 143 | variant of SEQ ID NO: 1 | 2 | Q487A, D590N |
| SEQ ID NO: 144 | variant of SEQ ID NO: 1 | 2 | Q487A, A649E |
| SEQ ID NO: 145 | variant of SEQ ID NO: 1 | 2 | V550I, D590N |
| SEQ ID NO: 146 | variant of SEQ ID NO: 1 | 2 | S556T, T564E |
| SEQ ID NO: 147 | variant of SEQ ID NO: 1 | 2 | S556T, D590N |
| SEQ ID NO: 148 | variant of SEQ ID NO: 1 | 2 | S556T, A649E |
| SEQ ID NO: 149 | variant of SEQ ID NO: 1 | 2 | T564E, D590N |
| SEQ ID NO: 150 | variant of SEQ ID NO: 1 | 2 | T564E, L712M |
| SEQ ID NO: 151 | variant of SEQ ID NO: 1 | 2 | D590N, A649E |
| SEQ ID NO: 152 | variant of SEQ ID NO: 1 | 2 | D590N, L712M |
| SEQ ID NO: 153 | variant of SEQ ID NO: 1 | 2 | A649E, L712M |
| SEQ ID NO: 154 | variant of SEQ ID NO: 1 | 13 | L114I, N225V, A304I, T323I, G357A, P383V, Q487A, V550I, S556T, T564E, D590N, A649E, L712M |
| SEQ ID NO: 155 | variant of SEQ ID NO: 1 | 13 | L114I, I118V, N225V, T323I, G357A, P383V, Q487A, V550I, S556T, T564E, D590N, A649E, L712M |
| SEQ ID NO: 156 | variant of SEQ ID NO: 1 | 13 | L114I, I118V, N225V, A304I, T323I, P383V, Q487A, V550I, S556I, T564E, D590N, A649E, L712M |
| SEQ ID NO: 157 | variant of SEQ ID NO: 1 | 13 | L114I, I118V, N225V, A304I, T323I, G357A, Q487A, V550I, S556T, T564E, D590N, A649E, L712M |
| SEQ ID NO: 158 | variant of SEQ ID NO: 1 | 13 | L114I, I118V, N225V, A304I, T323I, G357A, P383V, Q487A, V550I, S556T, T564E, A649E, L712M |
| SEQ ID NO: 159 | variant of SEQ ID NO: 1 | 13 | L114I, I118V, N225V, A304I, T323I, G357A, P383V, Q487A, V550I, S556T, T564E, D590N, A649E |
| SEQ ID NO: 160 | wild type, *Grifola frondosa*, UniProtKB/Swiss-Prot: O75003.1 | none | none |
| SEQ ID NO: 161 | variant of SEQ ID NO: 160 | 1 | L108I |
| SEQ ID NO: 162 | variant of SEQ ID NO: 160 | 1 | V112I |
| SEQ ID NO: 163 | variant of SEQ ID NO: 160 | 1 | N221V |
| SEQ ID NO: 164 | variant of SEQ ID NO: 160 | 1 | A300I |
| SEQ ID NO: 166 | variant of SEQ ID NO: 160 | 1 | T319I |
| SEQ ID NO: 166 | variant of SEQ ID NO: 160 | 1 | P379V |
| SEQ ID NO: 167 | variant of SEQ ID NO: 160 | 1 | S550T |
| SEQ ID NO: 168 | variant of SEQ ID NO: 160 | 1 | Q558E |
| SEQ ID NO: 169 | variant of SEQ ID NO: 160 | 1 | A643E |
| SEQ ID NO: 170 | variant of SEQ ID NO: 160 | 1 | L707M |
| SEQ ID NO: 171 | variant of SEQ ID NO: 160 | 2 | L108I, N221V |
| SEQ ID NO: 172 | variant of SEQ ID NO: 160 | 2 | L108I, A300I |
| SEQ ID NO: 173 | variant of SEQ ID NO: 160 | 2 | L108I, T319I |
| SEQ ID NO: 174 | variant of SEQ ID NO: 160 | 2 | L108I, V483A |
| SEQ ID NO: 175 | variant of SEQ ID NO: 160 | 2 | L108I, S550T |
| SEQ ID NO: 176 | variant of SEQ ID NO: 160 | 2 | P379V, L108I |
| SEQ ID NO: 177 | variant of SEQ ID NO: 160 | 2 | P379V, V112I |
| SEQ ID NO: 178 | variant of SEQ ID NO: 160 | 2 | P379V, N221V |
| SEQ ID NO: 179 | variant of SEQ ID NO: 160 | 2 | P379V, A300I |
| SEQ ID NO: 180 | variant of SEQ ID NO: 160 | 2 | P379V, T319I |
| SEQ ID NO: 181 | variant of SEQ ID NO: 160 | 2 | P379V, F345Y |
| SEQ ID NO: 182 | variant of SEQ ID NO: 160 | 2 | P379V, V483A |
| SEQ ID NO: 183 | variant of SEQ ID NO: 160 | 2 | P379V, V544I |
| SEQ ID NO: 184 | variant of SEQ ID NO: 160 | 2 | P379V, S550T |

TABLE 1-continued

Overview over Sequence IDs.

| SEQ ID | Source | No of mutations | Mutations (numbering refers to reference sequence specified column 2) |
|---|---|---|---|
| SEQ ID NO: 185 | variant of SEQ ID NO: 160 | 3 | P379V, V483A, Q558E |
| SEQ ID NO: 186 | variant of SEQ ID NO: 160 | 3 | P379V, V544I, S550T |
| SEQ ID NO: 187 | variant of SEQ ID NO: 160 | 3 | P379V, V544I, Q558E |
| SEQ ID NO: 188 | variant of SEQ ID NO: 160 | 3 | P379V, S550T, Q558E |
| SEQ ID NO: 189 | variant of SEQ ID NO: 160 | 4 | P379V, V483A, V544I, Q558E |
| SEQ ID NO: 190 | variant of SEQ ID NO: 1 | 14 | L114I, I118V, N225V, A304I, T323I, G357A, P383V, Q487L, V550I, S556T, T564E, D590N, A649E, L712M |
| SEQ ID NO: 191 | wild type, *Schizophyllum commune* H4-8, NCBI Reference Sequence: Xp_003035156.1 | none | none |
| SEQ ID NO: 192 | wild type, *Trametes cinnabarine*, Genbank: CDO74881.1 | none | none |
| SEQ ID NO: 193 | wild type, *Hypsizygus marmoreus*, Genbank: KYQ39707.1 | none | none |
| SEQ ID NO: 194 | wild type, *Trametes versicolor* FP-101664 SS1, NCBI Reference Sequence: XP_008036133.1 | none | none |
| SEQ ID NO: 195 | wild type, *Pleurotus pulmonarius*, UniProtKB/Swiss-Prot: A6YRN9.1 | none | none |
| SEQ ID NO: 196 | wild type, *Agaricus bisporus* var. *bisporus* H97, NCBI Reference Sequence: XP_006458503.1 | none | none |
| SEQ ID NO: 197 | wild type, *Agaricus bisporus* var. *burnettii* JB137-S8, NCBI Reference Sequence: XP_007326883.1 | none | none |
| SEQ ID NO: 198 | wild type, *Laetiporus sulphureus* 93-53, Genbank: KZT11205.1 | none | none |
| SEQ ID NO: 199 | wild type, *Gloeophyllum trabeum* ATCC 11539, NCBI Reference Sequence: XP_007863746.1 | none | none |
| SEQ ID NO: 200 | wild type, *Grifola frondosa*, Genbank: OBZ75413.1 | none | none |
| SEQ ID NO: 201 | wild type, *Trametes pubescens*, Genbank: OJT04097.1 | none | none |
| SEQ ID NO: 202 | wild type, *Bifidobacterium magnum*, NCBI Reference Sequence: WP_022860341.1 | none | none |
| SEQ ID NO: 203 | wild type, *Bifidobacterium longum*, GenBank: ADQ02266.1 | none | none |
| SEQ ID NO: 204 | wild type, *Bifidobacterium animalis*, NCBI Reference Sequence: WP_004218429.1 | none | none |
| SEQ ID NO: 205 | wild type, *Bifidobacterium thermophilum*, NCBI Reference Sequence: WP_015449645.1 | none | none |
| SEQ ID NO: 206 | wild type, *Bifidobacterium adolescensis*, NCBI Reference Sequence: WP_011742626.1 | none | none |
| SEQ ID NO: 207 | variant of SEQ ID NO: 202 | 1 | E92L |
| SEQ ID NO: 208 | variant of SEQ ID NO: 202 | 1 | S124Q |
| SEQ ID NO: 209 | variant of SEQ ID NO: 202 | 1 | S124K |
| SEQ ID NO: 210 | variant of SEQ ID NO: 202 | 1 | S124T |
| SEQ ID NO: 211 | variant of SEQ ID NO: 202 | 1 | A148R |
| SEQ ID NO: 212 | variant of SEQ ID NO: 202 | 1 | A148K |
| SEQ ID NO: 213 | variant of SEQ ID NO: 202 | 1 | T157D |
| SEQ ID NO: 214 | variant of SEQ ID NO: 202 | 1 | Q188Y |

TABLE 1-continued

Overview over Sequence IDs.

| SEQ ID | Source | No of mutations | Mutations (numbering refers to reference sequence specified column 2) |
|---|---|---|---|
| SEQ ID NO: 215 | variant of SEQ ID NO: 202 | 1 | I231V |
| SEQ ID NO: 216 | variant of SEQ ID NO: 202 | 1 | L371A |
| SEQ ID NO: 217 | variant of SEQ ID NO: 202 | 1 | T461G |
| SEQ ID NO: 218 | variant of SEQ ID NO: 202 | 2 | A148K, Q188Y |
| SEQ ID NO: 219 | variant of SEQ ID NO: 202 | 5 | A148K, T157D, Q188Y, L371A, T461G |
| SEQ ID NO: 220 | wild type, *Streptomyces* sp. SK, PDB: 4HHL_A | none | none |
| SEQ ID NO: 221 | variant to SEQ ID NO: 220 | 1 | A33I |
| SEQ ID NO: 222 | variant to SEQ ID NO: 220 | 1 | A33N |
| SEQ ID NO: 223 | variant to SEQ ID NO: 220 | 1 | L34F |
| SEQ ID NO: 224 | variant to SEQ ID NO: 220 | 1 | D35C |
| SEQ ID NO: 225 | variant to SEQ ID NO: 220 | 1 | F53L |
| SEQ ID NO: 226 | variant to SEQ ID NO: 220 | 1 | A89V |
| SEQ ID NO: 227 | variant to SEQ ID NO: 220 | 1 | T90S |
| SEQ ID NO: 228 | variant to SEQ ID NO: 220 | 1 | T95R |
| SEQ ID NO: 229 | variant to SEQ ID NO: 220 | 1 | T95Y |
| SEQ ID NO: 230 | variant to SEQ ID NO: 220 | 1 | R10K |
| SEQ ID NO: 231 | variant to SEQ ID NO: 220 | 1 | I59F |
| SEQ ID NO: 232 | variant to SEQ ID NO: 220 | 3 | R10K, F53L, T95Y |
| SEQ ID NO: 233 | variant to SEQ ID NO: 220 | 4 | R10K, F53L, T90S, T95Y |
| SEQ ID NO: 234 | variant to SEQ ID NO: 220 | 5 | R10K, A33N, F53L, T90S, T95Y |
| SEQ ID NO: 235 | variant to SEQ ID NO: 220 | 3 | R10K, F53L, T90S |
| SEQ ID NO: 236 | variant to SEQ ID NO: 220 | 4 | R10K, A89V, T90S, T95Y |
| SEQ ID NO: 237 | variant to SEQ ID NO: 220 | 5 | R10K, A33I, F53L, T90S, T95Y |
| SEQ ID NO: 238 | variant to SEQ ID NO: 220 | 5 | R10K, D35S, F53L, T90S, T95Y |
| SEQ ID NO: 239 | variant to SEQ ID NO: 220 | 4 | R10K, A33N, I59F, T90S |
| SEQ ID NO: 240 | variant to SEQ ID NO: 220 | 5 | R10K, A33I, D358, I59F, T90S |

TABLE 2

Amino acids and corresponding positions after alignment with SEQ ID NO: 1 of different wild type Trehalose phosphorylases at the positions 114, 118, 225, 304, 323, 349, 383, 487, 550, 556, 564, 590, 649, 712 of SEQ ID NO: 1 (The alignment was done using Clustal omega (Goujon M, McWilliam H, Li W, Valentin F, Squizzato S, Paern J, Lopez R Nucleic acids research 2010 July, 38 Suppl: W695-9).

| SEQ ID | Source | Genbank/ Uniprot | | 114 | 118 | 225 | 304 | 323 | 349 | 383 |
|---|---|---|---|---|---|---|---|---|---|---|
| SEQ ID NO: 1 | *Schizophyllum commune* | ABC84380.1 | postition amino acid | 114 L | 118 I | 225 N | 304 A | 323 T | 349 F | 383 P |
| SEQ ID NO: 191 | *Schizophyllum commune* H4-8 | XP_003035156.1 | postition amino acid | 114 L | 118 I | 225 N | 304 A | 323 T | 349 F | 383 P |
| SEQ ID NO: 80 | *Hypholoma sublateritium* FD-334 SS-4 | KJA27491.1 | postition amino acid | 70 L | 74 V | 183 N | 262 A | 281 T | 307 F | 341 P |
| SEQ ID NO: 193 | *Hypsizygus marmoreus* | KYQ39707.1 | postition amino acid | 108 L | 112 V | 221 N | 300 A | 319 T | 345 F | 379 P |
| SEQ ID NO: 192 | *Trametes cinnabarina* | CDO74881.1 | postition amino acid | 2 P | 6 S | 115 N | 194 L | 213 T | 239 F | 273 P |
| SEQ ID NO: 160 | *Grifola frondosa* | O75003.1 | postition amino acid | 108 L | 112 V | 221 N | 300 A | 319 T | 345 F | 379 P |
| SEQ ID NO: 81 | *Grifola frondosa* | ADM15725.1 | postition amino acid | 108 L | 112 V | 221 N | 300 A | 319 T | 345 F | 379 P |
| SEQ ID NO: 82 | *Pleurotus ostreatus* PC15 | KDQ33172.1 | postition amino acid | 110 L | 114 I | 223 N | 302 A | 321 T | 347 F | 381 P |
| SEQ ID NO: 195 | *Pleurotus pulmonarius* | A6YRN9.1 | postition amino acid | 112 L | 116 I | 225 N | 304 A | 323 T | 349 F | 383 P |
| SEQ ID NO: 194 | *Trametes versicolor* FP-101664 SS1 | XP_008036133.1 | postition amino acid | 111 L | 115 V | 224 N | 303 L | 322 T | 348 F | 382 P |
| SEQ ID NO: 196 | *Agaricus bisporus* var. *bisporus* H97 | XP_006458503.1 | postition amino acid | 110 L | 114 V | 223 N | 302 A | 321 T | 347 F | 381 P |
| SEQ ID NO: 197 | *Agaricus bisporus* var. *burnettii* JB137-S8 | XP_007326883.1 | postition amino acid | 110 L | 114 V | 223 N | 302 A | 321 T | 347 F | 381 P |

TABLE 2-continued

Amino acids and corresponding positions after alignment with SEQ ID NO: 1 of different wild type Trehalose phosphorylases at the positions 114, 118, 225, 304, 323, 349, 383, 487, 550, 556, 564, 590, 649, 712 of SEQ ID NO: 1 (The alignment was done using Clustal omega (Goujon M, McWilliam H, Li W, Valentin F, Squizzato S, Paern J, Lopez R Nucleic acids research 2010 July, 38 Suppl: W695-9).

| SEQ ID | Source | Genbank/Uniprot | | | | | | | |
|---|---|---|---|---|---|---|---|---|---|
| SEQ ID NO: 198 | *Laetiporus sulphureus* 93-53 | KZT11205.1 | postition amino acid | 108 L | 112 V | 221 N | 300 A | 319 T | 345 F | 380 P |
| SEQ ID NO: 83 | *Lentinus sajor-caju* (*Pleurotus sajor-caju*) | Q9UV63.1 | postition amino acid | 112 L | 116 I | 225 N | 304 A | 323 T | 349 F | 383 P |
| SEQ ID NO: 199 | *Gloeophyllum trabeum* ATCC 11539 | XP_007863746.1 | postition amino acid | 106 L | 110 V | 227 N | 306 L | 325 T | 351 F | 385 P |
| SEQ ID NO: 200 | *Grifola frondosa* | OBZ75413.1 | postition amino acid | 108 L | 112 V | 221 N | 300 V | 319 T | 345 F | 379 P |
| SEQ ID NO: 201 | *Trametes pubescens* | OJT04097.1 | postition amino acid | 70 L | 74 V | 183 N | — | — | 263 F | 297 P |

| SEQ ID | Source | Genbank/Uniprot | | | | | | | |
|---|---|---|---|---|---|---|---|---|---|
| SEQ ID NO: 1 | *Schizophyllum commune* | ABC84380.1 | postition amino acid | 487 Q | 550 V | 556 S | 564 T | 590 D | 649 A | 712 L |
| SEQ ID NO: 191 | *Schizophyllum commune* H4-8 | XP_003035156.1 | postition amino acid | 487 Q | 550 V | 556 S | 564 T | 590 D | 649 V | 712 L |
| SEQ ID NO: 80 | *Hypholoma sublateritium* FD-334 SS-4 | KJA27491.1 | postition amino acid | 445 T | 509 V | 515 S | 523 Q | 550 N | 609 A | 672 M |
| SEQ ID NO: 193 | *Hypsizygus marmoreus* | KYQ39707.1 | postition amino acid | 483 A | 546 V | 552 S | 560 Q | 587 N | 646 A | 709 M |
| SEQ ID NO: 192 | *Trametes cinnabarina* | CDO74881.1 | postition amino acid | 377 V | 438 V | 444 S | 452 Q | 478 N | 537 A | 601 L |
| SEQ ID NO: 160 | *Grifola frondosa* | O75003.1 | postition amino acid | 483 V | 544 V | 550 S | 558 Q | 584 N | 643 A | 707 L |
| SEQ ID NO: 81 | *Grifola frondosa* | ADM15725.1 | postition amino acid | 483 I | 544 V | 550 S | 558 Q | 584 N | 643 A | 707 L |
| SEQ ID NO: 82 | *Pleurotus ostreatus* PC15 | KDQ33172.1 | postition amino acid | 485 A | 549 V | 555 S | 563 A | 590 N | 649 D | 712 L |
| SEQ ID NO: 195 | *Pleurotus pulmonarius* | A6YRN9.1 | postition amino acid | 487 A | 551 V | 557 S | 565 A | 592 N | 651 D | 714 L |
| SEQ ID NO: 194 | *Trametes versicolor* FP-101664 SS1 | XP_008036133.1 | postition amino acid | 486 V | 547 V | 553 S | 561 Q | 587 N | 646 A | 710 L |
| SEQ ID NO: 196 | *Agaricus bisporus* var. *bisporus* H97 | XP_006458503.1 | postition amino acid | 485 A | 549 V | 555 S | 563 Q | 590 N | 649 E | 712 L |
| SEQ ID NO: 197 | *Agaricus bisporus* var. *burnettii* JB137-S8 | XP_007326883.1 | postition amino acid | 485 A | 549 V | 555 S | 563 Q | 590 N | 649 E | 712 L |
| SEQ ID NO: 198 | *Laetiporus sulphureus* 93-53 | KZT11205.1 | postition amino acid | 484 A | 545 V | 551 S | 559 A | 585 N | 644 E | 708 M |
| SEQ ID NO: 83 | *Lentinus sajor-caju* (*Pleurotus sajor-caju*) | Q9UV63.1 | postition amino acid | 499 A | 563 V | 569 S | 577 A | 604 N | 663 D | 726 F |
| SEQ ID NO: 199 | *Gloeophyllum trabeum* ATCC 11539 | XP_007863746.1 | postition amino acid | 489 V | 552 V | 558 S | 566 G | 592 N | 651 E | 715 L |
| SEQ ID NO: 200 | *Grifola frondosa* | OBZ75413.1 | postition amino acid | 483 S | 505 V | 511 S | 519 Q | 545 N | 604 A | 668 L |
| SEQ ID NO: 201 | *Trametes pubescens* | OJT04097.1 | postition amino acid | 401 V | 462 V | 468 S | 476 Q | 502 N | 561 A | 625 L |

EXAMPLES

Example 1: Cloning of Wild Type Enzymes and Creation of Mutants

Preparation of recombinant expression strains: All genes of the wild type enzymes, i.e. the trehalose phosphorylase gene from *S. commune*, the trehalose phosphorylase gene from *G. frondosa*, the sucrose phosphorylase gene from *B. magnum* and the glucose isomerase gene from *Streptomyces* sp. SK, were codon-optimized for expression in *E. coli* and synthesized by Eurofins MWG Operon or Geneart Thermo Fisher Scientific. The genes were cloned into the expression vector pLE1A17 (derivative of pRSF-1b, Novagen). The resulting plasmids were used for transformation of *E. coli* BL21 (DE3), of *E. coli* W3110 or of *E. coli* W3110 derivatives which carry certain deletions of endogenous enzyme genes (jointly referred to as "Expression hosts").

Molecular biology methods: Mutants of the enzymes were created by standard site-directed mutagenesis technologies as known in the state of the art.

Example 2: Preparation of Enzyme Preparations

Preparation of TP enzyme preparations: Expression hosts containing recombinant TPs were expressed in shaking flasks by inoculating Medium I (4.6 g/L yeast extract, 9.3 g/L peptone, 25 mM $Na_2HPO_4*12 H_2O$, 25 mM $KH_2PO_4$, 50 mM $NH_4Cl_2$, $Na_2SO_4$, 5 g/L glycerol, 0.5 g/L glucose*$1H_2O$, 2 mM $MgSO_4$, 50 µg/mL kanamycin) with a fresh overnight culture. Cultures were grown at 37° C. up to an optical density at 600 nm of 0.6-0.8. Cultures were induced with 0.1 mM IPTG final concentration. Expression was at 24-25° C. overnight. For the preparation of cell extract without sucrose cells were harvested by centrifugation and suspended in a buffer containing 50 mM potassium phosphate-buffer pH 7, 2 mM $MgCl_2$, 0.5 mg/mL lysozyme and 20 U/mL nuclease. Cells were disrupted by sonication. Cell free extract containing soluble enzyme was separated from the debris by centrifugation. For the preparation of cell extract with sucrose as a stabilizing agent, cells were harvested by centrifugation and suspended in a buffer containing 100 mM potassium phosphate-buffer pH 7, 2 mM $MgCl_2$, 0.5 mg/mL lysozyme and 20 U/mL nuclease. Cells were disrupted by sonication. Cell free extract containing soluble enzyme was separated from the debris by centrifugation and diluted 1:2 with 2 M sucrose solution.

Preparation of SP enzyme preparations: Expression hosts containing recombinant SP was expressed by inoculating Medium I (4.6 g/L yeast extract, 9.3 g/L peptone, 25 mM $Na_2HPO_4*12H_2O$, 25 mM $KH_2PO_4$, 50 mM $NH_4Cl_2$, $Na_2SO_4$, 5 g/L glycerol, 0.5 g/L glucose*$1H_2O$, 2 mM $MgSO_4$, 50 µg/mL kanamycin) with a fresh overnight culture. Cultures were grown at 37° C. up to an optical density at 600 nm of 0.6-0.8. Cultures were induced with 0.1 mM IPTG final concentration. Expression was at 30° C. overnight. Preparation of cell free extract was done using procedures well known as described elsewhere. Cells were harvested by centrifugation and suspended in a buffer containing 50 mM potassium phosphate buffer pH 7, 2 mM $MgCl_2$, 0.5 mg/mL lysozyme and 20 U/mL nuclease. Cell disruption was achieved by sonication or repeated freeze/thaw cycles. Cell free extract containing soluble enzyme was separated from the debris by centrifugation.

Preparation of GI enzyme preparations: Expression hosts containing recombinant SP was expressed by inoculating Medium I (4.6 g/L yeast extract, 9.3 g/L peptone. 25 mM $Na_2HPO_412H_2O$. 25 mM $KH_2PO_4$, 50 mM $NH_4Cl_2$, $Na_2SO_4$, 5 g/L glycerol; 0.5 g/L glucose*$1H_2O$, 2 mM $MgSO_4$, 50 µg/mL kanamycin) with a fresh overnight culture. Cultures were grown at 37° C. up to an optical density at 600 nm of 0.8-1.0. Cultures were induced with 0.1 mM IPTG final concentration. Expression was at 30° C. overnight. Preparation of cell free extract was done by harvesting cells by centrifugation followed by chemoenzymatic lysis. For this, the cells were suspended in a buffer containing 50 mM potassium phosphate buffer pH 7, 1× CelLytic™ B Cell Lysis Reagent (Sigma), 2 mM $Mg^{2+}$ (as $MgCl_2$ or $MgSO_4$), 0.5 mg/mL lysozyme and 20 U/mL nuclease, and incubated for 45 min at 30° C. Cell free extract containing soluble enzyme was separated from the debris by centrifugation for 30 min at 3.270×g and 4'C.

Example 3: Effect of Sucrose on Thermal Stability

50 µL aliquots of enzyme preparations of TP of SEQ ID NO: 1 from Example 2 with and without 1 M sucrose were incubated for 15 min at temperatures ranging from 36 to 53.7° C. Denatured protein was separated by centrifugation. The activity of the resulting supernatants as well as cell extract without a heat inactivation step was determined using the following Assay: Phosphorolytic activity was assayed at 30° C. using a continuous coupled assay in which the aG1P produced from trehalose is converted to glucose-6-phosphate by phosphoglucomutase. Glucose-6-phosphate and NADP is converted to 6-phospho-gluconate and NADPH by glucose 6-phosphate dehydrogenase. The detection is based on measuring the absorbance of NADPH at 340 nm. The assay solution contained: 75 mM potassium phosphate buffer pH 7. 2.5 mM NADP, 10 µM glucose 1,6-bisphosphate. 10 mM $MgCl_2$. 225 mM trehalose, 3 U/mL phosphoglucomutase and 3.4 U/mL glucose 6-phosphate dehydrogenase. 1 U is defined as the amount of enzyme that catalyzes the production of 1 µmol of aG1P at the specified conditions. FIG. 1 is a denaturing profile of SEQ ID NO: 1 with and without 1 M sucrose as a stabilizing agent showing the obtained residual activities compared to the enzyme preparations without heat inactivation. The addition of 1 M sucrose results in an increase of Tm50 from approx. 40° C. to 47.5° C. 1 M sucrose was therefore chosen as a stabilizing agent for TP.

Example 4: Residual Activity of TP Variants

50 µL aliquots of enzyme preparations of TP enzymes of SEQ ID NO: 1-79; SEQ ID NO: 84-159 and SEQ ID NO: 190 from Example 2 with 1 M sucrose were incubated for 15 min at 52° C. Denatured protein was separated by centrifugation. The activity of the resulting supernatants as well as cell extract without a heat inactivation step s determined using the following Assay: Synthetic activity was assayed at 40° C. using the following conditions: 50 mM sodium ES buffer pH 7, 100 m aG1P and 500 mM glucose. Reaction progress was determined discontinuously by measuring liberated phosphate with an assay based on the complex formation with molybdate under acidic conditions. The molybdate complex is reduced by ferrous sulfate and yields a blue color, which is analyzed photometrically at 750 nm. For the analysis 250 µL of sample are mixed with 250 µL 0.5 M HCl and 500 µL molybdate-reagent (73.2 g/L Fe(II) $SO_4*7H_2O$ and 10 g/L ammonium molybdate*$4H_2O$ in 3.5% sulfuric acid). After incubation at RT for 15-30 min, absorbance is measured at 750 nm. The amount of inorganic phosphate in the sample is quantified using external standards. 1 U is d fined as the amount of enzyme that catalyzes the production of 1 µmol of inorganic phosphate at the specified conditions. Residual activity was calculated by dividing the activity after the heat treatment by the activity without heat treatment and multiplication by 100. The resulting residual activities are listed in Table 3.

TABLE 3

Residual activity in % after 15 min incubation at 52° C.

| SEQ ID | residual activity in % after 15 min incubation at 52° C. |
|---|---|
| SEQ ID NO: 1 | 19 |
| SEQ ID NO: 2 | 30 |
| SEQ ID NO: 3 | 64 |
| SEQ ID NO: 4 | 30 |
| SEQ ID NO: 5 | 39 |
| SEQ ID NO: 6 | 54 |
| SEQ ID NO: 7 | 55 |
| SEQ ID NO: 8 | 42 |
| SEQ ID NO: 9 | 63 |

TABLE 3-continued

Residual activity in % after 15 min incubation at 52° C.

| SEQ ID | residual activity in % after 15 min incubation at 52° C. |
|---|---|
| SEQ ID NO: 10 | 68 |
| SEQ ID NO: 11 | 39 |
| SEQ ID NO: 12 | 55 |
| SEQ ID NO: 13 | 61 |
| SEQ ID NO: 14 | 30 |
| SEQ ID NO: 15 | 75 |
| SEQ ID NO: 16 | 43 |
| SEQ ID NO: 17 | 50 |
| SEQ ID NO: 18 | 41 |
| SEQ ID NO: 19 | 48 |
| SEQ ID NO: 20 | 75 |
| SEQ ID NO: 21 | 52 |
| SEQ ID NO: 22 | 37 |
| SEQ ID NO: 23 | 36 |
| SEQ ID NO: 24 | 47 |
| SEQ ID NO: 25 | 41 |
| SEQ ID NO: 26 | 45 |
| SEQ ID NO: 27 | 42 |
| SEQ ID NO: 28 | 31 |
| SEQ ID NO: 29 | 55 |
| SEQ ID NO: 30 | 38 |
| SEQ ID NO: 31 | 33 |
| SEQ ID NO: 32 | 39 |
| SEQ ID NO: 33 | 31 |
| SEQ ID NO: 34 | 53 |
| SEQ ID NO: 35 | 51 |
| SEQ ID NO: 36 | 34 |
| SEQ ID NO: 37 | 37 |
| SEQ ID NO: 38 | 39 |
| SEQ ID NO: 39 | 35 |
| SEQ ID NO: 40 | 46 |
| SEQ ID NO: 41 | 51 |
| SEQ ID NO: 42 | 43 |
| SEQ ID NO: 43 | 42 |
| SEQ ID NO: 44 | 55 |
| SEQ ID NO: 45 | 32 |
| SEQ ID NO: 46 | 43 |
| SEQ ID NO: 47 | 41 |
| SEQ ID NO: 48 | 35 |
| SEQ ID NO: 49 | 53 |
| SEQ ID NO: 50 | 96 |
| SEQ ID NO: 51 | 106 |
| SEQ ID NO: 52 | 99 |
| SEQ ID NO: 53 | 105 |
| SEQ ID NO: 54 | 105 |
| SEQ ID NO: 55 | 77 |
| SEQ ID NO: 56 | 106 |
| SEQ ID NO: 57 | 84 |
| SEQ ID NO: 58 | 88 |
| SEQ ID NO: 59 | 86 |
| SEQ ID NO: 60 | 113 |
| SEQ ID NO: 61 | 117 |
| SEQ ID NO: 62 | 101 |
| SEQ ID NO: 63 | 79 |
| SEQ ID NO: 64 | 101 |
| SEQ ID NO: 65 | 99 |
| SEQ ID NO: 66 | 105 |
| SEQ ID NO: 67 | 99 |
| SEQ ID NO: 68 | 92 |
| SEQ ID NO: 69 | 104 |
| SEQ ID NO: 70 | 76 |
| SEQ ID NO: 71 | 97 |
| SEQ ID NO: 72 | 90 |
| SEQ ID NO: 73 | 105 |
| SEQ ID NO: 74 | 108 |
| SEQ ID NO: 75 | 107 |
| SEQ ID NO: 76 | 97 |
| SEQ ID NO: 78 | 109 |
| SEQ ID NO: 79 | 97 |
| SEQ ID NO: 84 | 29 |
| SEQ ID NO: 85 | 23 |
| SEQ ID NO: 86 | 28 |
| SEQ ID NO: 87 | 38 |
| SEQ ID NO: 88 | 38 |
| SEQ ID NO: 89 | 42 |
| SEQ ID NO: 90 | 28 |
| SEQ ID NO: 91 | 40 |
| SEQ ID NO: 92 | 25 |
| SEQ ID NO: 93 | 35 |
| SEQ ID NO: 94 | 31 |
| SEQ ID NO: 95 | 35 |
| SEQ ID NO: 96 | 29 |
| SEQ ID NO: 97 | 38 |
| SEQ ID NO: 98 | 64 |
| SEQ ID NO: 99 | 22 |
| SEQ ID NO: 100 | 22 |
| SEQ ID NO: 101 | 54 |
| SEQ ID NO: 102 | 26 |
| SEQ ID NO: 103 | 41 |
| SEQ ID NO: 104 | 78 |
| SEQ ID NO: 105 | 33 |
| SEQ ID NO: 106 | 29 |
| SEQ ID NO: 107 | 30 |
| SEQ ID NO: 108 | 26 |
| SEQ ID NO: 109 | 33 |
| SEQ ID NO: 110 | 56 |
| SEQ ID NO: 111 | 43 |
| SEQ ID NO: 112 | 25 |
| SEQ ID NO: 113 | 63 |
| SEQ ID NO: 114 | 32 |
| SEQ ID NO: 115 | 72 |
| SEQ ID NO: 116 | 24 |
| SEQ ID NO: 117 | 37 |
| SEQ ID NO: 118 | 25 |
| SEQ ID NO: 119 | 32 |
| SEQ ID NO: 120 | 29 |
| SEQ ID NO: 121 | 72 |
| SEQ ID NO: 122 | 27 |
| SEQ ID NO: 123 | 32 |
| SEQ ID NO: 124 | 27 |
| SEQ ID NO: 125 | 55 |
| SEQ ID NO: 126 | 25 |
| SEQ ID NO: 127 | 23 |
| SEQ ID NO: 128 | 30 |
| SEQ ID NO: 129 | 23 |
| SEQ ID NO: 130 | 51 |
| SEQ ID NO: 131 | 31 |
| SEQ ID NO: 132 | 64 |
| SEQ ID NO: 133 | 67 |
| SEQ ID NO: 134 | 61 |
| SEQ ID NO: 135 | 59 |
| SEQ ID NO: 136 | 63 |
| SEQ ID NO: 137 | 56 |
| SEQ ID NO: 138 | 70 |
| SEQ ID NO: 139 | 62 |
| SEQ ID NO: 140 | 69 |
| SEQ ID NO: 141 | 62 |
| SEQ ID NO: 142 | 26 |
| SEQ ID NO: 143 | 28 |
| SEQ ID NO: 144 | 23 |
| SEQ ID NO: 145 | 29 |
| SEQ ID NO: 146 | 34 |
| SEQ ID NO: 147 | 55 |
| SEQ ID NO: 148 | 26 |
| SEQ ID NO: 149 | 43 |
| SEQ ID NO: 150 | 34 |
| SEQ ID NO: 151 | 40 |
| SEQ ID NO: 152 | 56 |
| SEQ ID NO: 153 | 26 |
| SEQ ID NO: 154 | 81 |
| SEQ ID NO: 155 | 68 |
| SEQ ID NO: 156 | 94 |
| SEQ ID NO: 157 | 69 |
| SEQ ID NO: 158 | 74 |
| SEQ ID NO: 159 | 87 |
| SEQ ID NO: 190 | 100 |

50 µL aliquots enzyme preparations of TP enzymes of SEQ ID 0: 160-189 from Example 2 with 1 M sucrose were incubated for 15 min at 52.5° C. Denatured protein was separated by centrifugation. The activity of the resulting supernatants as well as cell extract without a heat inactivation step was determined using the following Assay: Synthetic activity was assayed at 40° C. using the following conditions: 50 mM sodium MES buffer pH 7, 100 mM aG1P and 500 mM glucose. Reaction progress was determined discontinuously by measuring liberated phosphate with an assay based on the complex formation with molybdate under acidic conditions. The molybdate complex is reduced by ferrous sulfate and yields a blue color, which is analyzed photometrically at 750 nm. For the analysis 250 µL of sample are mixed with 250 µL 0.5 M HCl and 500 µL molybdate-reagent (73.2 g/L Fe(II)SO$_4$*7H$_2$O and 10 g/L ammonium molybdate*4H$_2$O in 3.5% sulfuric acid). After incubation at RT for 15-30 min, absorbance is measured at 750 nm. The amount of inorganic phosphate in the sample is quantified using external standards. 1 U is defined as the amount of enzyme that catalyzes the production of 1 µmol of inorganic phosphate at the specified conditions. Residual activity was calculated by dividing the activity after the heat treatment by the activity without heat treatment and multiplication by 100. The resulting residual activities are listed in Table 4. As can be seen, the residual activity of SEQ ID NO: 176, 178, 180, 185 and SEQ ID NO: 188 are above 50% which means that the Tm50-values of these sequences are above 52.5° C.

TABLE 4

Residual activity in % after 15 min incubation at 52° C.

| SEQ ID | residual activity in % after 15 min incubation at 52.5° C. [%] |
| --- | --- |
| SEQ ID NO: 160 | 9 |
| SEQ ID NO: 161 | 14 |
| SEQ ID NO: 162 | 22 |
| SEQ ID NO: 163 | 33 |
| SEQ ID NO: 164 | 26 |
| SEQ ID NO: 165 | 37 |
| SEQ ID NO: 166 | 37 |
| SEQ ID NO: 167 | 20 |
| SEQ ID NO: 168 | 34 |
| SEQ ID NO: 169 | 12 |
| SEQ ID NO: 170 | 15 |
| SEQ ID NO: 171 | 37 |
| SEQ ID NO: 172 | 29 |
| SEQ ID NO: 173 | 42 |
| SEQ ID NO: 174 | 12 |
| SEQ ID NO: 175 | 25 |
| SEQ ID NO: 176 | 57 |
| SEQ ID NO: 177 | 42 |
| SEQ ID NO: 178 | 56 |
| SEQ ID NO: 179 | 38 |
| SEQ ID NO: 180 | 74 |
| SEQ ID NO: 181 | 16 |
| SEQ ID NO: 182 | 28 |
| SEQ ID NO: 183 | 21 |
| SEQ ID NO: 184 | 43 |
| SEQ ID NO: 185 | 58 |
| SEQ ID NO. 186 | 42 |
| SEQ ID NO: 187 | 49 |
| SEQ ID NO: 188 | 70 |
| SEQ ID NO: 189 | 41 |

Example 5: Determination of Tm50 Values of TPs with Sucrose

50 µL aliquots of enzyme preparations of TP enzymes of SEQ ID NO: 1, SEQ ID NO: 44, SEQ ID NO: 50, SEQ ID NO: 54, SEQ ID NO: 57, SEQ ID NO: 58, SEQ ID NO: 62, SEQ ID NO: 64, SEQ ID NO: 65, SEQ ID NO: 71, SEQ ID NO: 72, SEQ ID NO: 73, SEQ ID NO: 74, SEQ ID NO: 78, SEQ ID NO: 79, SEQ ID NO: 160, SEQ ID NO: 180 and SEQ ID NO: 188 from Example 2 with 1 M sucrose were incubated for 15 min at temperatures ranging from 36 to 53.7° C. Denatured protein was separated by centrifugation. The activity of the resulting supernatants as well as cell extract without a heat inactivation step was determined using the following Assay: Phosphorolytic activity was assayed at 30° C. using a continuous coupled assay in which the aG1P produced from trehalose is converted to glucose-6-phosphate by phosphoglucomutase. Glucose-6-phosphate and NADP is converted to 6-phospho-gluconate and NADPH by glucose 6-phosphate dehydrogenase. The detection is based on measuring the absorbance of NADPH at 340 nm. The assay solution contained: 75 mM potassium phosphate buffer pH 7, 2.5 mM NADP, 10 µM glucose 1,6-bisphosphate, 10 mM MgCl$_2$, 225 mM trehalose, 3 U/mL phosphoglucomutase and 3.4 U/mL glucose 6-phosphate dehydrogenase. 1 U is defined as the amount of enzyme that catalyzes the production of 1 µmol of aG1P at the specified conditions. Residual activity was calculated by dividing the activity after the heat treatment by the activity without heat treatment and multiplication by 100. The Tm50-value was determined as the temperature at which the enzyme possesses 50% residual activity (Table 5).

TABLE 5

Tm50-values of TP enzymes in 50 mM potassium phosphate buffer pH 7 containing 1 M sucrose

| SEQ ID | Tm50 value |
| --- | --- |
| SEQ ID NO: 1 | 47.5 |
| SEQ ID NO: 44 | 52 |
| SEQ ID NO: 50 | 53.5 |
| SEQ ID NO: 54 | 54.5 |
| SEQ ID NO: 57 | 54.5 |
| SEQ ID NO: 58 | 54.5 |
| SEQ ID NO: 62 | 56 |
| SEQ ID NO: 64 | 56 |
| SEQ ID NO: 65 | 56 |
| SEQ ID NO: 71 | 56 |
| SEQ ID NO: 72 | 56.5 |
| SEQ ID NO: 73 | 57.5 |
| SEQ ID NO: 74 | 56 |
| SEQ ID NO: 78 | 56 |
| SEQ ID NO: 79 | 56 |

Example 6: Determination of Tm50 Values of SPs

50 µL aliquots of enzyme preparations of SP enzymes of SEQ ID NO: 202, SEQ ID NO: 203, SEQ ID NO: 204, SEQ ID NO: 205, SEQ ID NO: 206, SEQ ID NO: 212, SEQ ID NO: 214, SEQ ID NO: 218 and SEQ ID NO: 219 from Example 2 were incubated for 15 min at temperatures ranging from 50° C.80° C. After a regeneration step for 30 minutes on ice, and after centrifugation to remove precipitated protein, the sucrose phosphorylase activities in the supernatant were determined using the following assay: Phosphorolytic activity of a sucrose phosphorylase was assayed at 30° C. using a continuous coupled assay in which the aG1P produced from sucrose substrate is converted to glucose-6-phosphate by phosphoglucomutase. Glucose-6-phosphate and NADP is converted to 6-phospho-gluconate and NADPH by glucose 6-phosphate dehydrogenase. The detection is based on measuring the absorbance of NADPH at 340 nm. The assay solution contained: 75 mM potassium phosphate buffer pH 7, 2.5 mM NADP. 10 µM glucose 1,6-bisphosphate, 10 mM MgCl$_2$, 250 mM sucrose. 3 U/mL phosphoglucomutase and 3.4 U/mL glucose 6-phosphate dehydrogenase. 1 U is defined as the amount of enzyme that catalyzes the production of 1 µmol of aG1P at the specified conditions. Additionally, the activity of cell extract without heat treatment was determined using the same assay. Residual activity was calculated by dividing the activity after the heat treatment by the activity without heat treatment and multiplication by 100. The Tm50-value was determined as the temperature at which the enzyme possesses 50% residual activity (Table 6).

TABLE 6

Tm50-value of SP enzymes

| SEQ ID | Tm50 value |
| --- | --- |
| SEQ ID NO. 202 | 65° C. |
| SEQ ID NO: 203 | 68° C. |
| SEQ ID NO: 204 | 72° C. |
| SEQ ID NO: 205 | 72° C. |
| SEQ ID NO: 206 | 69° C. |
| SEQ ID NO: 212 | 68.5° C. |
| SEQ ID NO: 214 | 64.5° C. |
| SEQ ID NO: 218 | 70° C. |
| SEQ ID NO: 219 | 66.5° C. |

Example 7: Thermostability of GIs

Denaturation profiles of glucose isomerase variants were determined by performing heat inactivation at different temperatures followed by activity measurements. Glucose isomerase preparations from Example 2 were divided into several aliquots. 60 µL aliquots of each glucose isomerase variant was incubated at temperatures in the range 65-85° C. for 15 min. Denatured protein was separated by centrifugation for 10 min at 4° C. and 3,270×g. The Activity of the supernatant was determined using the following assay: Glucose isomerase activity was assayed by monitoring the formation of glucose from fructose at 40° C. using the following conditions: 50 mM potassium phosphate buffer pH 7, 10 Mg$^{2+}$ (as MgCl$_2$ or MgSO$_4$), 0.2 mL/mL reaction glucose isomerase enzyme preparations (diluted in 50 mM potassium phosphate buffer pH 7 so as to reach a maximum yield of 18%) and 200 mM fructose. The glucose produced from fructose by the action of glucose isomerase was determined using a discontinuous coupled assay in which the glucose is converted to glucose-6-phosphate by hexokinase. Glucose-6-phosphate and NADP is converted to 6-phospho-gluconate and NADPH by glucose 6-phosphate dehydrogenase. The detection is based on measuring the absorbance of NADPH at 340 nm. The D-GLUCOSE—HK kit (HK/G6P-DH Format) was employed in the microplate format (product no. K-GLUHK-110A or K-GLUHK-220A available from Megazyme International Ireland, Wicklow, Ireland). The assay is performed according to the manufacturer recommendations and the amount of glucose in the sample is quantified using external standards. Another aliquot of each glucose isomerase variant was assayed directly for activity without heat-inactivation using the same assay. Residual activity was calculated by dividing the activity after the heat treatment by the activity without heat treatment and multiplication by 100. The Tm50-value was determined as the temperature at which the enzyme possesses 50% residual activity (Table 7).

TABLE 7

Tm50-values of glucose isomerase variants in 50 mM potassium phosphate buffer pH 7

| SEQ ID | Tm50 value |
| --- | --- |
| SEQ ID NO: 220 | 78° C. |
| SEQ ID NO: 236 | 76° C. |

Example 8: Determination of Process Stability

Process stability of the TPs of SEQ ID NO: 1, SEQ ID NO: 14, SEQ ID NO: 44, SEQ ID NO: 62, SEQ ID NO: 64, SEQ ID NO: 65, SEQ ID NO: 78, SEQ ID NO: 160, SEQ ID NO: 180 and SEQ ID NO: 188 was determined at 45° C. in 50 mM potassium phosphate buffer pH 7 containing 1M sucrose. Enzyme preparations with 1 M sucrose from Example 2 were diluted in 50 mM potassium phosphate buffer pH 7 containing 1M sucrose and incubated at 45° C. for 16 days. Samples were taken over time and the activity was measured using the following assay: Phosphorolytic activity was assayed at 30° C. using a continuous coupled assay in which the aG1P produced from trehalose is converted to glucose-6-phosphate by phosphoglucomutase. Glucose-6-phosphate and NADP is converted to 6-phosphogluconate and NADPH by glucose 6-phosphate dehydrogenase. The detection is based on measuring the absorbance of NADPH at 340 nm. The assay solution contained: 75 mM potassium phosphate buffer pH 7, 2.5 mM NADP, 10 µM glucose 1,6-bisphosphate. 10 mM MgCl$_2$. 225 mM trehalose, 3 U/mL phosphoglucomutase and 3.4 U/mL glucose 6-phosphate dehydrogenase. 1 U is defined as the amount of enzyme that catalyzes the production of 1 µmol of aG1P at the specified conditions. Residual activity was calculated by dividing the activity after the heat treatment by the activity without heat treatment and multiplication by 100. The results are shown in FIG. 2. SEQ ID NO: 1 showed a rapid activity loss within the first 3 hours and a half-life of approx. 1 hour. As expected from the Tm50-values, the new variants showed greatly improved process stability. SEQ ID NO: 62, SEQ ID NO: 65 and SEQ ID NO: 78 showed the highest improvements with half-lives of approx. 8.8 days. This constitutes an over 200-fold improvement compared to the wild-type enzyme.

Example 9: Trehalose Synthesis: Three-Enzyme (3E) Process at Different Temperatures An SP enzyme is added to reaction aliquots containing 110 mM potassium phosphate buffer pH 7.5, 1.25 M sucrose, a GI enzyme and a TP enzyme preheated to 30° C., 45° C., 50° C. or 55° C., respectively. In order to avoid aG1P degrading side reactions, all enzymes are either heat purified (e.g. 15 min at 55° C. 60° C. or any other suitable temperature) obtained from a deletion strain, or purified using any biochemical method known in the art, such as precipitation or chromatography. Reactions are incubated at 30° C., 45° C. 50° C. or 55° C. at 500 rpm. SP enzymes may be selected from SEQ ID NO: 202, SEQ ID NO: 203, SEQ ID NO: 204, SEQ ID NO: 205, SEQ ID NO: 206, SEQ ID NO: 207, SEQ ID NO: 208, SEQ ID NO: 209, SEQ ID NO: 210, SEQ ID NO: 211, SEQ ID NO: 212, SEQ ID NO: 213, SEQ ID NO: 214, SEQ ID NO: 215, SEQ ID NO: 216, SEQ ID NO: 217, SEQ ID NO: 218, SEQ ID NO: 219: TP enzymes may be selected from SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41 SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO; 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 150, SEQ ID NO: 151, SEQ ID NO: 152, SEQ ID NO: 153, SEQ ID NO: 154, SEQ ID NO: 155, SEQ ID NO: 156, SEQ ID NO: 157, SEQ ID NO: 158, SEQ ID NO: 159, SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197, SEQ ID NO: 198, SEQ ID NO: 199, SEQ ID NO: 200, SEQ ID NO: 201; GI enzymes may be selected from SEQ ID NO: 220, SEQ ID NO: 221, SEQ ID NO: 222, SEQ ID NO: 223, SEQ ID NO: 224, SEQ ID NO: 225, SEQ ID NO: 226, SEQ ID NO: 227, SEQ ID NO: 228, SEQ ID NO: 229, SEQ ID NO: 230, SEQ ID NO: 231, SEQ ID NO: 232, SEQ ID NO: 233, SEQ ID NO: 234, SEQ ID NO: 235, SEQ ID NO: 236, SEQ ID NO: 237, SEQ ID NO: 238, SEQ ID NO: 239, SEQ ID NO: 240. Samples are taken over time and the amount of fructose, glucose, sucrose and trehalose is determined by HPLC (column: Luna 5 μm NH$_2$ 100 Å, 250×4.6 mm (Phenomenex), column temperature: 40° C., mobile phase: 80/20 (v/v) acetonitrile/water, isocratic analysis, flow rate: 2 mL/min, injection: 10 μL. The amount of fructose, glucose, sucrose and trehalose in the sample is quantified using external standards). Alternatively, SP of SEQ ID NO: 10 or 11 and/or GI of SEQ ID NO: 11 can be used.

Example 10: Trehalose Synthesis: Three-Enzyme (3E) Process at Different Sucrose Concentrations Similarly to Example 5, a SP enzyme is added to reaction aliquots containing 110 mM potassium phosphate buffer pH 7.5, a GI enzyme, a TP enzyme and either 300 mM or 1 M sucrose. In order to avoid aG1P degrading side reactions, all enzymes are either heat purified (e.g. 15 min at 55° C., 60° C. or any other suitable temperature) obtained from a deletion strain, or purified using any biochemical method known in the art, such as precipitation or chromatography. SP enzymes may be selected from SEQ ID NO: 202, SEQ ID NO: 203, SEQ ID NO: 204, SEQ ID NO: 205, SEQ ID NO: 206, SEQ ID NO: 207, SEQ ID NO: 208, SEQ ID NO: 209, SEQ ID NO: 210, SEQ ID NO: 211, SEQ ID NO: 212, SEQ ID NO: 213, SEQ ID NO: 214, SEQ ID NO: 215, SEQ ID NO: 216, SEQ ID NO: 217, SEQ ID NO: 218, SEQ ID NO: 219; TP enzymes may be selected from SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO; 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105. SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122. SEQ ID NO: 123, SEQ ID NO: 124, SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO:

142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 150, SEQ ID NO: 151, SEQ ID NO: 152, SEQ ID NO: 153, SEQ ID NO: 154, SEQ ID NO: 155, SEQ ID NO: 156, SEQ ID NO: 157, SEQ ID NO: 158, SEQ ID NO: 159, SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197, SEQ ID NO: 198, SEQ ID NO: 199, SEQ ID NO: 200, SEQ ID NO: 201; GI enzymes may be selected from SEQ ID NO: 220, SEQ ID NO: 221, SEQ ID NO: 222, SEQ ID NO: 223, SEQ ID NO: 224, SEQ ID NO: 225, SEQ ID NO: 226, SEQ ID NO: 227, SEQ ID NO: 228, SEQ ID NO: 229, SEQ ID NO: 230, SEQ ID NO: 231, SEQ ID NO: 232, SEQ ID NO: 233, SEQ ID NO: 234. SEQ ID NO: 235, SEQ ID NO: 236, SEQ ID NO: 237, SEQ ID NO: 238, SEQ ID NO: 239, SEQ ID NO: 240. Reactions are incubated at 45° C. at 500 rpm. Samples are taken over time and the amount of fructose, glucose, sucrose and trehalose is determined by HPLC (column: Luna 5 μm NH$_2$ 100 Å, 250×4.6 mm (Phenomenex), column temperature: 40° C., mobile phase: 80/20 (v/v) acetonitrile/water, isocratic analysis, flow rate: 2 ml/min, injection: 10 μL. The amount of fructose, glucose, sucrose and trehalose in the sample is quantified using external standards).

Example 11: Trehalose Synthesis: Two-Enzyme (2E) Process

An SP enzyme is added to reaction aliquots containing 110 mM potassium phosphate buffer pH 7.5, 300 mM sucrose, 300 mM glucose and a TP enzyme preheated to 30° C., 50° C. or 55° C., respectively. In order to avoid aG1P degrading side reactions, all enzymes are either heat purified (e.g. 15 min at 55° C., 60° C. or any other suitable temperature) obtained from a deletion strain, or purified using any biochemical method known in the art, such as precipitation or chromatography. Reactions are incubated at 30° C., 50° C. or 55° C. at 500 rpm. SP enzymes may be selected from SEQ ID NO: SEQ ID NO: 202, SEQ ID NO: 203, SEQ ID NO: 204, SEQ ID NO: 205, SEQ ID NO: 206, SEQ ID NO: 207, SEQ ID NO: 208, SEQ ID NO: 209, SEQ ID NO: 210, SEQ ID NO: 211, SEQ ID NO: 212, SEQ ID NO: 213, SEQ ID NO: 214, SEQ ID NO: 215, SEQ ID NO: 216, SEQ ID NO: 217, SEQ ID NO: 218, SEQ ID NO: 219; TP enzymes may be selected from SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 150, SEQ ID NO: 151. SEQ ID NO: 152, SEQ ID NO: 153, SEQ ID NO: 154, SEQ ID NO: 155, SEQ ID NO: 156, SEQ ID NO: 157, SEQ ID NO: 158, SEQ ID NO: 159, SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168. SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197, SEQ ID NO: 198, SEQ ID NO: 199, SEQ ID NO: 200, SEQ ID NO: 201. Samples are taken over time and the amount of fructose, glucose, sucrose and trehalose is determined by HPLC (column: Luna 5 μm NH$_2$ 100 Å, 250×4.6 mm (Phenomenex), column temperature: 40° C., mobile phase: 80/20 (v/v) acetonitrile/water, isocratic analysis, flow rate: 2 mL/min, injection: 10 μL. The amount of fructose, glucose, sucrose and trehalose in the sample is quantified using external standards).

Example 12: Determination of $K_M$-Value

Activity of glucose isomerase variants was determined at different fructose concentrations in the range 50-1000 mM fructose at the following conditions: 10 mM MgSO$_4$, 50 mM potassium phosphate buffer pH 7.0. 40° C., using the following assay: The reaction for measuring glucose isomerase activity was conducted by monitoring the formation of glucose from fructose at following conditions: 50 mM potassium phosphate buffer pH 7, 10 mM MgSO$_4$, 0.05 mL/mL reaction glucose isomerase enzyme preparations (diluted in 50 mM potassium phosphate buffer pH 7 so as to reach a maximum yield of 18%), 50-1000 mM fructose concentrations, and 40° C., The reaction was quenched by adding 0.1 mL 0.25 M HCl per mL reaction. The glucose produced from fructose by the action of glucose isomerase was determined using a discontinuous coupled assay in which glucose was converted to gluconolactone by glucose oxidase. Hydrogen peroxide, a by-product of this reaction, was used by horseradish peroxidase to oxidize 2,2'-azino-bis(3-ethylbenzothiazoline-6-sulphonic acid (ABTS), yielding a coloured product, which shows absorbance at 405 nm. A 10 µL aliquot of acid-quenched reaction is mixed with 90 µL of the assay mix containing 50 mM potassium phosphate buffer pH 6, 1 mM ABTS, 5 U/mL glucose oxidase and 1 U/mL horseradish peroxidase. After 60-70 min incubation at 30° C., the absorbance at 405 nm was measured (endpoint measurement). The amount of glucose in the sample is quantified using external standards. The resulting activities were fitted to the Michaelis-Menten equation from which a Michaelis constant $K_M$ for fructose for a given glucose isomerase variant was derived. As can be seen from Table 7, both tested variants show lower KM for fructose than the wild type glucose isomerase.

TABLE 7

$K_M$-value of glucose isomerase

| SEQ ID | $K_M$(fructose) [mM] |
|---|---|
| SEQ ID NO: 220 | 237 |
| SEQ ID NO: 236 | 152 |

Example 13: Trehalose Synthesis: Three-Enzyme Process at 30° C., 39° C. and 40° C.

Reaction aliquots containing potassium phosphate buffer pH 7.5, sucrose and MgSO$_4$ were preheated to 30° C., 39° C. or 40° C., respectively, and SP, GI and TP enzyme preparations were added thereto (final concentrations: 200 mM surose, 10 mM MgSO$_4$, 50 mM potassium phosphate buffer pH 7.5, 0.75 U/mL SP, 2.25 U/mL GI, 0.5 U/mL TP). The reaction containing TP enzyme preparation of SEQ ID NO: 160 had the following final composition: 200 mM surose, 10 mM MgSO$_4$, 50 mM potassium phosphate buffer pH 7.5, 0.405 U/mL SP, 1,215 U/mL GI, 0.27 U/mL TP. In order to avoid aG1P degrading side reactions, all enzymes were either heat purified (15 min at 60° C.), obtained from a deletion strain, or purified using any biochemical method known in the art, such as precipitation or chromatography. The commercial GI Sternenzym GI 3000 (Sternenzym GmbH & Co. KG, Ahrensburg) was desalted using a PD-10 column from GE Healthcare according to the manufacturers instructions and eluted in 50 mM potassium phosphate buffer pH 7. The commercial immobilized GI Sweetzyme® IT Extra (Novozymes, Sigma #G4166) was ground to a fine powder. Reactions were incubated with shaking at 500 rpm and at temperatures of 30° C., 39° C. or 40° C., respectively. Samples were taken after 23 h and the amount of trehalose was determined by HPLC (column: Luna 5 µm NH$_2$ 100 Å, 250×4.6 mm (Phenomenex), column temperature: 40° C., mobile phase: 80/20 (v/v) acetonitrile/water, isocratic analysis, flow rate: 2 mL/min, injection: 10 µL), The amount of trehalose in the sample was quantified using external standards.

The amount of trehalose formed and the Productivity per kU TP after 23 h at 30° C., 39° C. and 40° C. with different TP enzymes but using the same SP and GI enzyme are shown in Table 8.

TABLE 8

Trehalose formation after 23 h at 30° C., 39° C. or 40° C.

| TP | SP | GI | 30° C. Trehalose [mM] | 39° C. Trehalose [mM] | 40° C. Trehalose [mM] | 30° C. Productivity per kU TP ($g*L^{-1}*h^{-1}*kU^{-1}$) | 39° C. Productivity per kU TP ($g*L^{-1}*h^{-1}*kU^{-1}$) | 40° C. Productivity per kU TP ($g*L^{-1}*h^{-1}*kU^{-1}$) |
|---|---|---|---|---|---|---|---|---|
| SEQ ID NO: 1 | SEQ ID NO: 202 | Sternenzyme GI3000 | 28.5 | 0.0 | 0.0 | 0.9 | 0.0 | 0.0 |
| SEQ ID NO: 87 | SEQ ID NO: 202 | Sternenzyme GI3000 | 21.4 | 56.0 | 24.3 | 0.7 | 1.8 | 0.8 |
| SEQ ID NO: 89 | SEQ ID NO: 202 | Sternenzyme GI3000 | 27.1 | 32.9 | n.d. | 0.9 | 1.1 | n.d. |
| SEQ ID NO: 104 | SEQ ID NO: 202 | Sternenzyme GI3000 | 41.1 | 63.7 | 61.9 | 1.4 | 2.1 | 2.0 |
| SEQ ID NO: 115 | SEQ ID NO: 202 | Sternenzyme GI3000 | 19.4 | 45.1 | 32.0 | 0.6 | 1.5 | 1.1 |
| SEQ ID NO: 121 | SEQ ID NO: 202 | Sternenzyme GI3000 | 21.7 | 60.0 | 32.9 | 0.7 | 2.0 | 1.1 |
| SEQ ID NO: 138 | SEQ ID NO: 202 | Sternenzyme GI3000 | 35.5 | 71.9 | 70.2 | 1.2 | 2.4 | 2.3 |
| SEQ ID NO: 140 | SEQ ID NO: 202 | Sternenzyme GI3000 | 23.2 | 68.6 | 81.9 | 0.8 | 2.3 | 2.7 |
| SEQ ID NO: 147 | SEQ ID NO: 202 | Sternenzyme GI3000 | 28.7 | 85.3 | 85.1 | 0.9 | 2.8 | 2.8 |
| SEQ ID NO: 44 | SEQ ID NO: 202 | Sternenzyme GI3000 | 22.3 | 65.0 | 67.4 | 0.7 | 2.1 | 2.2 |
| SEQ ID NO: 62 | SEQ ID NO: 202 | Sternenzyme GI3000 | 24.1 | 85.2 | 97.4 | 0.8 | 2.8 | 3.2 |
| SEQ ID NO: 65 | SEQ ID NO: 202 | Sternenzyme GI3000 | 25.4 | 88.0 | 97.3 | 0.8 | 2.9 | 3.2 |
| SEQ ID NO: 78 | SEQ ID NO: 202 | Sternenzyme GI3000 | 28.6 | 75.0 | 95.4 | 0.9 | 2.5 | 3.1 |
| SEQ ID NO: 160 | SEQ ID NO: 202 | Sternenzyme GI3000 | 13.3 | 0.0 | 0.0 | 0.8 | 0.0 | 0.0 |

TABLE 8-continued

Trehalose formation after 23 h at 30° C., 39° C. or 40° C.

| TP | SP | GI | 30° C. Trehalose [mM] | 39° C. Trehalose [mM] | 40° C. Trehalose [mM] | 30° C. Productivity per kU TP ($g*L^{-1}*h^{-1}*kU^{-1}$) | 39° C. Productivity per kU TP ($g*L^{-1}*h^{-1}*kU^{-1}$) | 40° C. Productivity per kU TP ($g*L^{-1}*h^{-1}*kU^{-1}$) |
|---|---|---|---|---|---|---|---|---|
| SEQ ID NO: 180 | SEQ ID NO: 202 | Sternenzyme GI3000 | 20.9 | 31.2 | 24.5 | 0.7 | 1.0 | 0.8 |
| SEQ ID NO: 188 | SEQ ID NO: 202 | Sternenzyme GI3000 | 33.2 | 72.7 | 59.4 | 1.1 | 2.4 | 2.0 |

The data indicate that the use of TP variants is advantageous for trehalose synthesis in a trehalose synthesis process (three-enzyme process) with temperatures of 39'C and 40° C. in comparison to wildtype sequences SEQ ID NO:1 and SEQ ID NO: 160.

Table 9 shows the trehalose formation and the Productivity per kU TP after 23 h using different SP enzyme preparations together with either TP enzyme preparation of SEQ ID 1 or TP enzyme preparation of SEQ ID 65, respectively. In all assays, the same GI enzyme preparation has been added to the reaction.

TABLE 9

Trehalose formation after 23 h at 30° C., 39° C. or 40° C.

| TP | SP | GI | 30° C. Trehalose [mM] | 39° C. Trehalose [mM] | 40° C. Trehalose [mM] | 30° C. Productivity per kU TP ($g*L^{-1}*h^{-1}*kU^{-1}$) | 39° C. Productivity per kU TP ($g*L^{-1}*h^{-1}*kU^{-1}$) | 40° C. Productivity per kU TP ($g*L^{-1}*h^{-1}*kU^{-1}$) |
|---|---|---|---|---|---|---|---|---|
| SEQ ID NO: 1 | SEQ ID NO: 202 | Sternenzyme GI3000 | 28.5 | 0.0 | 0.0 | 0.9 | 0.0 | 0.0 |
| SEQ ID NO: 1 | SEQ ID NO: 218 | Sternenzyme GI3000 | 31.2 | 0.0 | 0.0 | 1.0 | 0.0 | 0.0 |
| SEQ ID NO: 1 | SEQ ID NO: 204 | Sternenzyme GI3000 | 29.5 | 0.0 | 0.0 | 1.0 | 0.0 | 0.0 |
| SEQ ID NO: 1 | SEQ ID NO: 205 | Sternenzyme GI3000 | 29.1 | 0.0 | 0.0 | 1.0 | 0.0 | 0.0 |
| SEQ ID NO: 65 | SEQ ID NO: 202 | Sternenzyme GI3000 | 25.4 | 88.0 | 97.3 | 0.8 | 2.9 | 3.2 |
| SEQ ID NO: 65 | SEQ ID NO: 218 | Sternenzyme GI3000 | 28.0 | 86.8 | 93.8 | 0.9 | 2.9 | 3.1 |
| SEQ ID NO: 65 | SEQ ID NO: 204 | Sternenzyme GI3000 | 26.2 | 87.9 | 94.1 | 0.9 | 2.9 | 3.1 |
| SEQ ID NO: 65 | SEQ ID NO: 205 | Sternenzyme GI3000 | 26.5 | 86.2 | 93.9 | 0.9 | 2.8 | 3.1 |

The data show that the advantages of producing trehalose by TP variants instead of wildtype enzymes are independent from the SP enzymes candidates present in the process. It is furthermore obvious, that different SP enzymes are suitable for trehalose synthesis.

Table 10 shows the trehalose formation and the Productivity per kU TP after 23 h using different GI enzyme preparations together with either TP enzyme preparation of SEQ ID 1 or TP enzyme preparation of SEQ ID 65. In all assays, the same SP enzyme preparation has been added to the reaction.

TABLE 10

Trehalose formation after 23 h at 30° C., 39° C. or 40° C.

| TP | SP | GI | 30° C. Trehalose [mM] | 39° C. Trehalose [mM] | 40° C. Trehalose [mM] | 30° C. Productivity per kU TP ($g*L^{-1}*h^{-1}*kU^{-1}$) | 39° C. Productivity per kU TP ($g*L^{-1}*h^{-1}*kU^{-1}$) | 40° C. Productivity per kU TP ($g*L^{-1}*h^{-1}*kU^{-1}$) |
|---|---|---|---|---|---|---|---|---|
| SEQ ID NO: 1 | SEQ ID NO: 202 | Sternenzyme GI3000 | 28.5 | 0.0 | 0.0 | 0.9 | 0.0 | 0.0 |
| SEQ ID NO: 1 | SEQ ID NO: 202 | SEQ ID NO: 220 | 20.7 | 0.0 | 0.0 | 0.7 | 0.0 | 0.0 |

TABLE 10-continued

Trehalose formation after 23 h at 30° C., 39° C., or 40° C.

| TP | SP | GI | 30° C. Trehalose [mM] | 39° C. Trehalose [mM] | 40° C. Trehalose [mM] | 30° C. Productivity per kU TP (g*L$^{-1}$* h$^{-1}$*kU$^{-1}$) | 39° C. Productivity per kU TP (g*L$^{-1}$* h$^{-1}$*kU$^{-1}$) | 40° C. Productivity per kU TP (g*L$^{-1}$* h$^{-1}$*kU$^{-1}$) |
|---|---|---|---|---|---|---|---|---|
| SEQ ID NO: 1 | SEQ ID NO: 202 | SEQ ID NO: 236 | 42.8 | 0.0 | 0.0 | 1.4 | 0.0 | 0.0 |
| SEQ ID NO: 1 | SEQ ID NO: 202 | Novozymes Sweetzyme | 21.2 | 0.0 | 0.0 | 0.7 | 0.0 | 0.0 |
| SEQ ID NO: 65 | SEQ ID NO: 202 | Sternenzyme GI3000 | 25.4 | 88.0 | 97.3 | 0.8 | 2.9 | 3.2 |
| SEQ ID NO: 65 | SEQ ID NO: 202 | SEQ ID NO: 220 | 24.2 | 41.3 | 40.8 | 0.8 | 1.4 | 1.3 |
| SEQ ID NO: 65 | SEQ ID NO: 202 | SEQ ID NO: 236 | 45.4 | 73.2 | 71.8 | 1.5 | 2.4 | 2.4 |
| SEQ ID NO: 65 | SEQ ID NO: 202 | Novozymes Sweetzyme | 23.0 | 35.1 | 53.9 | 0.8 | 1.2 | 1.8 |

The data show that the advantages of producing trehalose by TP variants instead of wildtype enzymes are independent from the GI enzyme candidates present in the process. It is furthermore obvious that different GI enzymes are suitable far trehalose synthesis.

Example 14: Trehalose Synthesis: Three-Enzyme (3E) Process at 200 mM, 600 mM and 900 mM Sucrose Reaction aliquots containing potassium phosphate buffer pH 7.5, sucrose and MgSO$_4$ were preheated to 30° C., and SP, GI and TP enzyme preparations were added thereto (final concentrations: 200 mM, 600 mM or 900 mM surose, respectively, 10 mM MgSO$_4$, 50 mM potassium phosphate buffer pH 7.5, 0.525 U/mL SP, 1.575 U/mL GI, 0.35 U/mL TP). In order to avoid aG1P degrading side reactions, all enzymes were either heat purified (15 min at 60° C.), obtained from a deletion strain, or purified using any biochemical method known in the art, such as precipitation or chromatography. The commercial GI Sternenzym GI 3000 (Sternenzym GmbH & Co. KG, Ahrensburg) was desalted using a PD-10 column from GE Healthcare according to the manufacturers instructions and eluted in 50 mM potassium phosphate buffer pH 7. The commercial immobilized GI Sweetzyme® IT Extra (Novozymes, Sigma #G4166) was ground to a fine powder. Reactions were incubated at 500 rpm at 30° C.

Samples were taken over time and the amount of trehalose was determined by HPLC (column: Luna 5 μm NH$_2$ 100 Å, 250×4.6 mm (Phenomenex), column temperature: 40° C., mobile phase: 80/20 (v/v) acetonitrile/water, isocratic analysis, flow rate: 2 ml/min, injection: 10 μL. The amount of trehalose in the sample was quantified using external standards). Results are shown in Table 11.

TABLE 11

Trehalose formation after 23 h using 200, 600 or 900 mM sucrose.

| TP | SP | GI | 200 mM sucrose Trehalose [mM] | 600 mM sucrose Trehalose [mM] | 900 mM sucrose Trehalose [mM] | 200 mM sucrose Productivity per kU TP (g*L$^{-1}$* h$^{-1}$*kU$^{-1}$) | 600 mM sucrose Productivity per kU TP (g*L$^{-1}$* h$^{-1}$*kU$^{-1}$) | 900 mM sucrose Productivity per kU TP (g*L$^{-1}$* h$^{-1}$*kU$^{-1}$) |
|---|---|---|---|---|---|---|---|---|
| SEQ ID NO: 1 | SEQ ID NO: 202 | Sternenzyme GI3000 | 22.9 | 22.8 | 23.3 | 1.08 | 1.07 | 1.10 |
| SEQ ID NO: 1 | SEQ ID NO: 218 | Sternenzyme GI3000 | 23.4 | 25.5 | 25.0 | 1.10 | 1.20 | 1.18 |
| SEQ ID NO: 1 | SEQ ID NO: 204 | Sternenzyme GI3000 | 23.2 | 24.0 | 24.8 | 1.09 | 1.13 | 1.16 |
| SEQ ID NO: 1 | SEQ ID NO: 205 | Sternenzyme GI3000 | 23.3 | 24.0 | 24.3 | 1.10 | 1.13 | 1.14 |
| SEQ ID NO: 87 | SEQ ID NO: 202 | Sternenzyme GI3000 | 18.2 | 19.6 | 20.0 | 0.86 | 0.92 | 0.94 |
| SEQ ID NO: 104 | SEQ ID NO: 202 | Sternenzyme GI3000 | 23.5 | 31.3 | 28.1 | 1.11 | 1.47 | 1.32 |
| SEQ ID NO: 115 | SEQ ID NO: 202 | Sternenzyme GI3000 | 14.2 | 15.2 | 15.1 | 0.67 | 0.72 | 0.71 |
| SEQ ID NO: 121 | SEQ ID NO: 202 | Sternenzyme GI3000 | 21.1 | 23.4 | 26.1 | 0.99 | 1.10 | 1.23 |
| SEQ ID NO: 138 | SEQ ID NO: 202 | Sternenzyme GI3000 | 25.5 | 30.8 | 28.6 | 1.20 | 1.45 | 1.34 |
| SEQ ID NO: 140 | SEQ ID NO: 202 | Sternenzyme GI3000 | 20.6 | 23.0 | 21.7 | 0.97 | 1.08 | 1.02 |
| SEQ ID NO: 147 | SEQ ID NO: 202 | Sternenzyme GI3000 | 21.0 | 22.3 | 21.9 | 0.99 | 1.05 | 1.03 |

TABLE 11-continued

Trehalose formation after 23 h using 200, 600 or 900 mM sucrose.

| TP | SP | GI | 200 mM sucrose Trehalose [mM] | 600 mM sucrase Trehalose [mM] | 900 mM sucrose Trehalose [mM] | 200 mM sucrose Productivity per kU TP (g*L$^{-1}$* h$^{-1}$*kU$^{-1}$) | 600 mM sucrose Productivity per kU TP (g*L$^{-1}$* h$^{-1}$*kU$^{-1}$) | 900 mM sucrose Productivity per kU TP (g*L$^{-1}$* h$^{-1}$*kU$^{-1}$) |
|---|---|---|---|---|---|---|---|---|
| SEQ ID NO: 44 | SEQ ID NO: 202 | Sternenzyme GI3000 | 17.5 | 18.2 | 16.5 | 0.82 | 0.86 | 0.77 |
| SEQ ID NO: 62 | SEQ ID NO: 202 | Sternenzyme GI3000 | 21.7 | 19.7 | 16.9 | 1.02 | 0.93 | 0.79 |
| SEQ ID NO: 65 | SEQ ID NO: 202 | Sternenzyme GI3000 | 22.2 | 23.4 | 21.0 | 1.04 | 1.10 | 0.99 |
| SEQ ID NO: 65 | SEQ ID NO: 218 | Sternenzyme GI3000 | 24.1 | 24.8 | 22.1 | 1.13 | 1.16 | 1.04 |
| SEQ ID NO: 65 | SEQ ID NO: 204 | Sternenzyme GI3000 | 23.9 | 23.4 | 20.3 | 1.12 | 1.10 | 0.96 |
| SEQ ID NO: 65 | SEQ ID NO: 205 | Sternenzyme GI3000 | 25.3 | 22.8 | 19.9 | 1.10 | 1.07 | 0.93 |

The data indicate that in the 3E trehalose synthesis process the TP and enzyme preparations do not show substrate inhibition up to 900 mM sucrose.

Example 15: Trehalose Synthesis: Two-Enzyme (2E) Process at 30° C., 42° C. and 43° C.

Reaction aliquots containing potassium phosphate buffer pH 7.5, sucrose, glucose and MgSO$_4$ were preheated to 30° C., 42° C. or 43° C., respectively, and SP and TP enzymes were added thereto (final concentrations: 200 mM surose, 200 mM glucose, 10 mM MgSO$_4$, 50 mM potassium phosphate buffer pH 7.5, 0.525 U/mL SP, 0.35 U/mL TP). In order to avoid aG1P degrading side reactions, all enzymes were either heat purified (15 min at 60° C.), obtained from a deletion strain, or purified using any biochemical method known in the art, such as precipitation or chromatography. The commercial GI Sternenzym GI 3000 (Sternenzym GmbH & Co. KG, Ahrensburg) was desalted using a PD-10 column from GE Healthcare according to the manufacturers instructions and eluted in 50 mM potassium phosphate buffer pH 7. Reactions were incubated at 500 rpm at 30° C., 42° C. or 43° C., respectively. Samples were taken over time and the amount of trehalose was determined by HPLC (column: Luna 5 μm NH$_2$ 100 Å, 250×4.6 mm (Phenomenex), column temperature: 40° C., mobile phase: 80120 (v/v) acetonitrile/water, isocratic analysis, flow rate: 2 mL/min, injection: 10 μL. The amount of trehalose in the sample was quantified using external standards).

Results are shown in Table 12.

TABLE 12

Trehalose formation after 23 h at 30° C., 42° C. and 43° C.

| TP | SP | 30° C. Trehalose [mM] | 42° C. Trehalose [mM] | 43° C. Trehalose [mM] | 30° C. Productivity per kU TP (g*L$^{-1}$* h$^{-1}$*kU$^{-1}$) | 42° C. Productivity per kU TP (g*L$^{-1}$* h$^{-1}$*kU$^{-1}$) | 43° C. Productivity per kU TP (g*L$^{-1}$* h$^{-1}$*kU$^{-1}$) |
|---|---|---|---|---|---|---|---|
| SEQ ID NO: 1 | SEQ ID NO: 202 | 61.5 | 0.0 | 0.0 | 2.9 | 0.0 | 0.0 |
| SEQ ID NO: 104 | SEQ ID NO: 202 | 121.4 | 117.5 | 101.8 | 5.7 | 5.5 | 4.8 |
| SEQ ID NO: 140 | SEQ ID NO: 202 | 68.1 | 104.5 | 102.2 | 3.2 | 4.9 | 4.8 |
| SEQ ID NO: 62 | SEQ ID NO: 202 | 64.8 | 106.7 | 108.6 | 3.0 | 5.0 | 5.1 |
| SEQ ID NO: 180 | SEQ ID NO: 202 | 102.2 | 67.4 | 5.7 | 4.8 | 3.2 | 0.3 |

The data indicate that the use of TP variants is advantageous for trehalose synthesis in a trehalose synthesis process (2E) with temperatures of 42° C. and 43° C. in comparison to wildtype sequence SEQ ID NO: 1.

SEQUENCE LISTING (240 sequences)

SEQ ID NO: 1 - protein, 737 aa, Schizophyllum commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 2 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPNGAWLNDLLREETGTPYVEGEPRLPRGGIKVQD

SEQ ID NO: 3 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMSGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 4 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPNGAWLNDMLREETGTPYVEGEPRLPRGGIKVQD

SEQ ID NO: 5 - protein, 737 aa, Artificial Sequence
  Description of Artificial Sequence: Synthetic polypeptide
MSPPHGFSSRPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQISRFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 6 - protein, 737 aa, Artificial Sequence
  Description of Artificial Sequence: Synthetic polypeptide
MSPPHGFSSRPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYFGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQISRFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 7 - protein, 737 aa, Artificial Sequence
  Description of Artificial Sequence: Synthetic polypeptide
MSPPHGFSSRPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYFGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 8 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYFGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQISRFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPNGAWLNDMLREETGTPYVEGEPRLPRGGIKVQD

SEQ ID NO: 9 - protein, 737 aa, Artificial Sequence
  Description of Artificial Sequence: Synthetic polypeptide
MSPPHGFSSRPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYFGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQISRFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPNGAWLNDMLREETGTPYVEGEPRLPRGGIKVQD

SEQ ID NO: 10 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 11 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRGYYMGEFRALCQADKMNTLDWPNREYCIQISRFDPSKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 12 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNYDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQISRFDPSKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 13 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNYDAWITKNGLRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGIFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 14 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 15 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNYDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGIFRALCQADKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 16 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNFDAWITKNGLRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGIFRALCQKDKMNTLDWPNREYCIQISRFDPSKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 17 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQADKMNTLDWPNREYCIQISRFDPSKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 18 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQADKMNTLDWPNREYCIQISRFDPSKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 19 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGIFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 20 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNYDAWITKNGLRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQADKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 21 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGIFRALCQKDKMNTLDWPNREYCIQISRFDPSKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 22 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLVAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 23 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTAGKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 24 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNVPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 25 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILHVDAAWYVPNPSPSVFRTTKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 26 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSHSVFRTTKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 27 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRITKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 28 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDIRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 29 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNYDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 30 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPASTDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 31 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGIFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 32 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRSLCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 33 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCVKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 34 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCAKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 35 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCLKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 36 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRELLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 37 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNVAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 38 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEARDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 39 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGGVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 40 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDAMDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 41 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAIDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 42 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDATIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 43 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLELIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 44 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLNCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 45 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLACLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 46 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNEQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 47 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDEMSQYARTHVSDEVGTVGNAAAWLYLAAVYTRGQKLAPKGAWLNDMLREETGTPYVEGEPRLPRGGIKVQD

SEQ ID NO: 48 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDKMSQYARTHVSDEVGTVGNAAAWLYLAAVYTRGQKLAPKGAWLNDMLREETGTPYVEGEPRLPRGGIKVQD

SEQ ID NO: 49 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLEPKGAWLNDMLREETGTPYVEGEPRLPRGGIKVQD

SEQ ID NO: 50 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAIDDPDATIIYDQVLTLIHEKYAEFAKDIVVMRLPPSDQLLNCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 51 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNVPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCLKDKMNTLDWPNREYCIQIARFDPAKGIPNVIDSYARFRRLLNEAGDVDADDQPQLLICGHGAVDDPDASIIYDQVLELIHEKYAEFAKDIVVMRLPPSDQLLNCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 52 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRITKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAIDDPDASIIYDQVLELIHEKYAEFAKDIVVMRLPPSDQLLNCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 53 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNVPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRITKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCLKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLNCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 54 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNVPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCLKDKMNTLDWPNREYCIQIARFDPAKGIPNVIDSYARFRRLLNEAGDVDADDQPQLLICGHGAIDDPDATIIYDQVLTLIHEKYAEFAKDIVVMRLPPSDQLLNCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 55 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNVPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCLKDKMNTLDWPNREYCIQIARFDPAKGIPNVIDSYARFRRLLNEAGDVDADDQPQLLICGHGAIDDPDASIIYDQVLELIHEKYAEFAKDIVVMRLPPSDQLLNCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 56 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNVPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAIDDPDATIIYDQVLELIHEKYAEFAKDIVVMRLPPSDQLLNCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 57 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNVPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAIDDPDASIIYDQVLELIHEKYAEFAKDIVVMRLPPSDQLLNCLMANARIALQLSTREGFEVKVSEAVHAGKPIIAATTGGIPLQVEHGKSGFLTEPGDNEQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 58 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRITKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAIDDPDATIIYDQVLELIHEKYAEFAKDIVVMRLPPSDQLLNCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 59 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRITKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCLKDKMNTLDWPNREYCIQIARFDPAKGIPNVIDSYARFRRLLNEAGDVDADDQPQLLICGHGAIDDPDASIIYDQVLTLIHEKYAEFAKDIVVMRLPPSDQLLNCLMANARIALQLSTREGFEVKVSEAVHAGKPIIAATTGGIPLQVEHGKSGFLTEPGDNEQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 60 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNVPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCAKDKMNTLDWPNREYCIQIARFDPAKGIPNVIDSYARFRRLLNEAGDVDADDQPQLLICGHGAIDDPDATIIYDQVLELIHEKYAEFAKDIVVMRLPPSDQLLNCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 61 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNVPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAIDDPDATIIYDQVLELIHEKYAEFAKDIVVMRLPPSDQLLNCLMANARIALQLSTREGFEVKVSEAVHAGKPIIAATTGGIPLQVEHGKSGFLTEPGDNEQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 62 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNVPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRITKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCLKDKMNTLDWPNREYCIQIARFDPAKGIPNVIDSYARFRRLLNEAGDVDADDQPQLLICGHGAIDDPDASIIYDQVLELIHEKYAEFAKDIVVMRLPPSDQLLNCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 63 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNVPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRITKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCLKDKMNTLDWPNREYCIQIARFDPAKGIPNVIDSYARFRRLLNEAGDVDADDQPQLLICGHGAIDDPDASIIYDQVLTLIHEKYAEFAKDIVVMRLPPSDQLLNCLMANARIALQLSTREGFEVKVSEAVHAGKPIIAATTGGIPLQVEHGKSGFLTEPGDNEQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 64 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNVPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRITKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCAKDKMNTLDWPNREYCIQIARFDPAKGIPNVIDSYARFRRLLNEAGDVDADDQPQLLICGHGAIDDPDATIIYDQVLTLIHEKYAEFAKDIVVMRLPPSDQLLNCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 65 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNVPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRITKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAIDDPDATIIYDQVLELIHEKYAEFAKDIVVMRLPPSDQLLNCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 66 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRITKNNHNILQGVASPDLRLTQEAKDNYDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCLKDKMNTLDWPNREYCIQIARFDPAKGIPNVIDSYARFRRLLNEAGDVDADDQPQLLICGHGAIDDPDASIIYDQVLTLIHEKYAEFAKDIVVMRLPPSDQLLNCLMANARIALQLSTREGFEVKVSEAVHAGKPIIAATTGGIPLQVEHGKSGFLTEPGDNEQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 67 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRITKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCAKDKMNTLDWPNREYCIQIARFDPAKGIPNVIDSYARFRRLLNEAGDVDADDQPQLLICGHGAIDDPDATIIYDQVLELIHEKYAEFAKDIVVMRLPPSDQLLNCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 68 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCAKDKMNTLDWPNREYCIQIARFDPAKGIPNVIDSYARFRRLLNEAGDVDADDQPQLLICGHGAIDDPDATIIYDQVLELIHEKYAEFAKDIVVMRLPPSDQLLNCLMANARIALQLSTREGFEVKVSEAVHAGKPIIAATTGGIPLQVEHGKSGFLTEPGDNEQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 69 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCLKDKMNTLDWPNREYCIQIARFDPAKGIPNVIDSYARFRRLLNEAGDVDADDQPQLLICGHGAIDDPDATIIYDQVLELIHEKYAEFAKDIVVMRLPPSDQLLNCLMANARIALQLSTREGFEVKVSEAVHAGKPIIAATTGGIPLQVEHGKSGFLTEPGDNEQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 70 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNVPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRITKNNHNILQGVASPDLRLTQEAKDNYDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAIDDPDATIIYDQVLTLIHEKYAEFAKDIVVMRLPPSDQLLNCLMANARIALQLSTREGFEVKVSEAVHAGKPIIAATTGGIPLQVEHGKSGFLTEPGDNEQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 71 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNVPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRITKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCLKDKMNTLDWPNREYCIQIARFDPAKGIPNVIDSYARFRRLLNEAGDVDADDQPQLLICGHGAIDDPDATIIYDQVLTLIHEKYAEFAKDIVVMRLPPSDQLLNCLMANARIALQLSTREGFEVKVSEAVHAGKPIIAATTGGIPLQVEHGKSGFLTEPGDNEQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 72 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNVPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNYDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCAKDKMNTLDWPNREYCIQIARFDPAKGIPNVIDSYARFRRLLNEAGDVDADDQPQLLICGHGAIDDPDATIIYDQVLELIHEKYAEFAKDIVVMRLPPSDQLLNCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 73 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNVPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNYDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCLKDKMNTLDWPNREYCIQIARFDPAKGIPNVIDSYARFRRLLNEAGDVDADDQPQLLICGHGAIDDPDASIIYDQVLELIHEKYAEFAKDIVVMRLPPSDQLLNCLMANARIALQLSTREGFEVKVSEAVHAGKPIIAATTGGIPLQVEHGKSGFLTEPGDNEQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 74 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNVPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCLKDKMNTLDWPNREYCIQIARFDPAKGIPNVIDSYARFRRLLNEAGDVDADDQPQLLICGHGAIDDPDATIIYDQVLELIHEKYAEFAKDIVVMRLPPSDQLLNCLMANARIALQLSTREGFEVKVSEAVHAGKPIIAATTGGIPLQVEHGKSGFLTEPGDNEQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 75 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNVPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCAKDKMNTLDWPNREYCIQIARFDPAKGIPNVIDSYARFRRLLNEAGDVDADDQPQLLICGHGAIDDPDATIIYDQVLELIHEKYAEFAKDIVVMRLPPSDQLLNCLMANARIALQLSTREGFEVKVSEAVHAGKPIIAATTGGIPLQVEHGKSGFLTEPGDNEQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 76 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRITKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCLKDKMNTLDWPNREYCIQIARFDPAKGIPNVIDSYARFRRLLNEAGDVDADDQPQLLICGHGAIDDPDATIIYDQVLELIHEKYAEFAKDIVVMRLPPSDQLLNCLMANARIALQLSTREGFEVKVSEAVHAGKPIIAATTGGIPLQVEHGKSGFLTEPGDNEQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 77 - protein, 737 aa, Artificial Sequence; identical to SEQ ID NO: 76
  Description of Artificial Sequence: Synthetic polypeptide

SEQ ID NO: 78 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNVPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRITKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCAKDKMNTLDWPNREYCIQIARFDPAKGIPNVIDSYARFRRLLNEAGDVDADDQPQLLICGHGAIDDPDATIIYDQVLELIHEKYAEFAKDIVVMRLPPSDQLLNCLMANARIALQLSTREGFEVKVSEAVHAGKPIIAATTGGIPLQVEHGKSGFLTEPGDNEQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 79 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNVPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRITKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCGKDKMNTLDWPNREYCIQIARFDPAKGIPNVIDSYARFRRLLNEAGDVDADDQPQLLICGHGAIDDPDATIIYDQVLELIHEKYAEFAKDIVVMRLPPSDQLLNCLMANARIALQLSTREGFEVKVSEAVHAGKPIIAATTGGIPLQVEHGKSGFLTEPGDNEQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 80 - protein, 696 aa, Hypholoma sublateritium FD-334 SS-4
  KJA27491.1
MWAAVAGAVINNNTQYEIAVSIHDSVYSTDFASSVLSFNPNNPDKNAKEIEQYVLQTLRMFSVGHLCKFLGAGVTLLLLKESPNLCTRLWLDMDIVPFVFNIKPFHTDSLTRPNIKHRISSTTGSYVPSGADTPTVYVDSAHLTAMSGLQTGVSGRLPIPRTLDEQADSAARKCLMYFGPGNNPRLSIGPRNQVTVDSAGKAHLIDDIDEYKATVGPRTWNAVVKLADELREKKVKIGFFSSTPQGGGVALMRHALIRFLTALDVDAAWYVPNPSPSVFRTTKNNHNILQGVAAPDLRLTQEAKDNFDAWILKNGLRWTAEGGPLAPGGVDIAFIDDPQMPGLIPLIKKIRPDLPIVYRSHIEIRSDLVHVPGSPQEEVWKYLWNNIQLADLFISHPVNKFVPSDVPIEKLALLGAATDWLDGLNKELDPWDSQYYMGEFRNLCTKEKMHTLNWPERDYVVQIARFDPAKGINNVIDSYYKFRNMLKEKSPDLTEEEHPQLLLCGHGAVDDPDASIIYDQVLQLVESEPYKTYAKDIVVMRLPPSDQLLNALMANSRIALQLSTREGFEVKVSEALHAGKPVIASRTGGIPLQIEHGKSGYLTTAGDNAAVANHLYELYTDEALYRKMSQYAKTHVSDEVGTVGNAASWLYLAVMYHRGIKIKPNGAWLNDMLREETGEEYVEGEPRLPRGGLTMQ

SEQ ID NO: 81 - protein, 732 aa, Grifola frondosa
  ADM15725.1 trehalose synthase
MAPPHQFQSKPSDVIRRRLSSAVSSKRPNVPGYTSLTPMWAGIAGAVVNNNSQFEVAISIHDSVYNTDFASSIVPYSPNEPEAQAGIIEKHVLETLRKFSTEHMCKFLGAGVTVILLREAPNLCTRLWLDMDIVPIVFNIKPFHTDSITRPNVRHRISSTTGSYVPSGAETPTVYYDPAQLQDPNKLSANVQTRLPIPRTVDEQADSAARKCIMYFGPGNNPRLQIGPRNQVAVDAGGKIHLIDDIDEYRKTVGKGTWNSVIKLADELREKKIKIGFFSSTPQGGGVALMRHAIIRFFTALDVDAAWYVPNPSPSVFRTTKNNHNILQGVADPSLRLTKEAADNFDSWILKNGLRWTAEGGPLAPGGVDIAFIDDPQVPGLIPLIKRIRPDLPIIYRSHIEIRSDLVHVKGSPQEEVWNYLWNNIQHSDLFISHPVNKFVPSDVPLEKLALLGAATDWLDGLSKHLDAWDAQYYMGEFRNLCIKEKMNELGWPARDYIVQIARFDPSKGIPNVIDSYARFRKLCVDKVMEDDIPQLLLCGHGAVDDPDASIIYDQVLQLIHAKYKEYAPDIVVMRCPPSDQLLNTLMANAKFALQLSTREGFEVKVSEALHAGKPVIACRTGGIPLQIEHGKSGYLCEPGDNAAVAQHMLDLYTDEDLYDTMSEYARTHVSDEVGTVGNAAAWMYLAVMYVSRGVKLRPHGAWINDLMRTEMGEPYRAGEPRLPRGELHVQG

SEQ ID NO: 82 - protein, 737 aa, Pleurotus ostreatus
  KDQ33172.1
MSTHHQFESKPSTAIRRRLSSSVSSKQRPNMTTTFASLTPMWAGVAGTLVNNNTQYEIAVTVHDGVYSTDFASVIIPVTPGDTAKNSKDIEAQVLNLIRKFSAEHLCKFLGAGITLALLKECPNLCTRLWLDMDIVPIVFNIKPFHTDSVTRPNIKHRISSTTGSYVPSGSETPTVYVEAAHLGDPSHLSPNAAQKLPIPRTLDEQSDSAARKCLMYFGPNNNPRLSIGARNQVTVDAGGKIHLIDDLEEYRKTVGTGTWNAVIKLADELREKKVKIGFFSSTPQGGGVALMRHALIRFLTALDVDVAWYVPNPSPQVFRTTKNNHNILQGVAAPDLRLTQDAKDAFDAWILKNGLRWTAEGGPLAPGGVDVVFIDDPQMPGLIPLIKKVRPEVPIVYRSHIEIRSDLVHVAGSPQEEVWKYLWNNIQLADLFISHPVSKFVPSDVPIEKLALLGAATDWLDGLNKDLDPWDSQFYMGEFRSLCAKEKMVELDWPTRDYIVQVARFDPSKGIPNVVDSYYKFRNLLRTRSPEMELSDHPQLLICGHGAVDDPDASIIYDQIMALVNSDPYKEYAHDIVVMRLPPSDELLNAMMANSRIALQLSTREGFEVKVSEALHTGKPVIACRTGGIPLQIQHGKSGYLTTPGDNDAVAGYLYDLYTDEALYRRMSDFARTHVSDEVGTVGNAAAWLYLAVMYSRGEKIKPNGAWINDLLREETGEPYKEGETKLPRTKLDMQG

SEQ ID NO: 83 - protein, 751 aa, Lentinus sajor-caju
  Q9UV63.1
MSTPHHQFESKSSTAIRRRLSSSVSSKQRPNIMTTTFASLTPMWAGVAGTLVNNNTQYEIAVTVHDGVYSTDFASVIIPVTPGDTVKNSKDIEAQVLNLIRKFSAEHLCKFLGAGITLALLKECPNLCTRLWLDMDIVPIVFNIKPFHTDSVTRPNIKHRISSTTGSYVPSGSETPTVYVEASHLGDPSHLSPNAAQKLPIPRTLDEQSDSAARKCLMYFGPNNNPRLSIGARNPVTVDAGGKIHLIDDLEEYRMTVGAGTWNAVIKLADELREKKVKIGFFSSTPQGGGVALMRHALIRFLTALDVDVAWYVPNPSPQVFRTTKNNHNILQGVAAPDLRLTQEAKDAFDAWILKNGLRWTAEGGPLAPGGVDVVFIDDPQMPGLIPLIKKVRPEVPIVYRSHIEIRNDLVHVAWSPQEEVWKYLWNNIQLADLFISHPVSKFVPSDVPTEKLALLGAATDWLDGLNKDLDPWDSPFYMGEFRPRGSHLNRGEFRSLCAKEKMHELNWPARDYIVQVARFDPSKGIPNVVDSYYKFRNLLRTRSPDMDESEHPQLLICGHGAVDDPDASIIYDQIMALVNSDPYKEYAHDIVVMRLPPSDELLNAMMANSRIALQLSTREGFEVKVSEALHTGKPVIACRTGGIPLQIQHGKSGYLTTPGEKDAVAGHFYDFYTDEALYRKMSDFARTHVSNEVGTVGNAAAWLYLAVMYSRGEKIKPNGAWINDFFREETGEPYKEGETKLPRTKLDMQG

SEQ ID NO: 84 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNVPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 85 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 86 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRITKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 87 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 88 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCAKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 89 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDATIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 90 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLELIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 91 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLNCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 92 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNIPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 93 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNLPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 94 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNMPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 95 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSLLDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 96 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRVTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 97 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMAGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 98 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMGGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 99 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMMGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 100 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMNGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 101 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMCGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 102 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMQGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 103 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMSGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 104 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMTGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 105 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCGKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 106 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCLKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 107 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCMKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 108 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAPDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 109 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLGCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 110 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 111 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDATIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 112 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLELIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 113 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLNCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 114 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNVPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 115 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNVPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 116 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNVPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCAKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 117 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNVPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAIDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 118 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNVPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDATIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 119 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNVPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLNCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 120 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRITKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 121 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNFDAWITKNGLRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 122 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCAKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 123 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDATIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 124 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLELIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 125 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLNCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 126 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRITKNNHNILQGVASPDLRLTQEAKDNFDAWITKNALRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 127 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRITKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCAKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 128 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRITKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDATIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 129 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRITKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLELIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 130 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRITKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLNCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 131 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRITKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNEQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 132 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNYDAWITKNGLRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 133 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNYDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLNCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 134 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 135 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNALRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLNCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 136 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCAKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 137 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAIDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 138 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDATIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 139 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLELIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 140 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLNCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 141 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNEQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 142 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCAKDKMNTLDWPNREYCIQIARFDPAKGIPNVIDSYARFRRLLNEAGDVDADDQPQLLICGHGAVDDPDASIIYDQVLELIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 143 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCAKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLNCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 144 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCAKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNEQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 145 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAIDDPDASIIYDQVLTLIHEKYAEFAKDIVVMRLPPSDQLLNCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 146 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDATIIYDQVLELIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 147 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDATIIYDQVLTLIHEKYAEFAKDIVVMRLPPSDQLLNCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 148 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDATIIYDQVLTLIHEKYAEFAKDIVVMRLPPSDQLLDCLMANARIALQLSTREGFEVKVSEAVHAGKPIIAATTGGIPLQVEHGKSGFLTEPGDNEQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 149 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLELIHEKYAEFAKDIVVMRLPPSDQLLNCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 150 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLELIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 151 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLNCLMANARIALQLSTREGFEVKVSEAVHAGKPIIAATTGGIPLQVEHGKSGFLTEPGDNEQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 152 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLNCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 153 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNEQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 154 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNVPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRITKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCAKDKMNTLDWPNREYCIQIARFDPAKGIPNVIDSYARFRRLLNEAGDVDADDQPQLLICGHGAIDDPDATIIYDQVLELIHEKYAEFAKDIVVMRLPPSDQLLNCLMANARIALQLSTREGFEVKVSEAVHAGKPIIAATTGGIPLQVEHGKSGFLTEPGDNEQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 155 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNVPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRITKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCAKDKMNTLDWPNREYCIQIARFDPAKGIPNVIDSYARFRRLLNEAGDVDADDQPQLLICGHGAIDDPDATIIYDQVLELIHEKYAEFAKDIVVMRLPPSDQLLNCLMANARIALQLSTREGFEVKVSEAVHAGKPIIAATTGGIPLQVEHGKSGFLTEPGDNEQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 156 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNVPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRITKNNHNILQGVASPDLRLTQEAKDNFDAWITKNGLRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCAKDKMNTLDWPNREYCIQIARFDPAKGIPNVIDSYARFRRLLNEAGDVDADDQPQLLICGHGAIDDPDATIIYDQVLELIHEKYAEFAKDIVVMRLPPSDQLLNCLMANARIALQLSTREGFEVKVSEAVHAGKPIIAATTGGIPLQVEHGKSGFLTEPGDNEQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 157 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNVPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRITKNNHNILQGVASPDLRLTQEAKDNFDAWITKNALRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCAKDKMNTLDWPNREYCIQIARFDPAKGIPNVIDSYARFRRLLNEAGDVDADDQPQLLICGHGAIDDPDATIIYDQVLELIHEKYAEFAKDIVVMRLPPSDQLLNCLMANARIALQLSTREGFEVKVSEAVHAGKPIIAATTGGIPLQVEHGKSGFLTEPGDNEQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 158 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNVPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRITKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCAKDKMNTLDWPNREYCIQIARFDPAKGIPNVIDSYARFRRLLNEAGDVDADDQPQLLICGHGAIDDPDATIIYDQVLELIHEKYAEFAKDIVVMRLPPSDQLLDCLMANARIALQLSTREGFEVKVSEAVHAGKPIIAATTGGIPLQVEHGKSGFLTEPGDNEQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 159 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNVPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRITKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCAKDKMNTLDWPNREYCIQIARFDPAKGIPNVIDSYARFRRLLNEAGDVDADDQPQLLICGHGAIDDPDATIIYDQVLELIHEKYAEFAKDIVVMRLPPSDQLLNCLMANARIALQLSTREGFEVKVSEAVHAGKPIIAATTGGIPLQVEHGKSGFLTEPGDNEQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 160 - protein, 732 aa, Grifola frondosa
MAPPHQFQSKPSDVIRRRLSSAVSSKRPNIPGYTSLTPMWAGIAGAVVNNNTQFEVAISIHDSVYNTDFASSVVPYSPNEPEAQAGIIEKHVLETLRKFSTEHMCKFLGAGVTVILLREAPNLCTRLWLDMDIVPIVFNIKPFHTDSITRPNVRHRISSTTGSYVPSGAETPTVYYDPAQLQDPNKLSANVQTRLPIPRTVDEQADSAARKCIMYFGPGNNPRLQIGPRNQVAVDAGGKIHLIDDIDEYRKTVGKGTWNSVIKLADELREKKIKIGFFSSTPQGGGVALMRHAIIRFFTALDVDAAWYVPNPSPSVFRTTKNNHNILQGVADPSLRLTKEAADNFDSWILKNGLRWTAEGGPLAPGGVDIAFIDDPQMPGLIPLIKRIRPDLPIIYRSHIEIRSDLVHVKGSPQEEVWNYLWNNIQHSDLFISHPVNKFVPSDVPLEKLALLGAATDWLDGLSKHLDAWDSQYYMGEFRNLCVKEKMNELGWPAREYIVQIARFDPSKGIPNVIDSYARFRKLCVDKVMEDDIPQLLLCGHGAVDDPDASIIYDQVLQLIHAKYKEYAPDIVVMRCPPSDQLLNTLMANAKFALQLSTREGFEVKVSEALHAGKPVIACRTGGIPLQIEHGKSGYLCEPGDNAAVAQHMLDLYTDEDLYDTMSEYARTHVSDEVGTVGNAAAWMYLAVMYVSRGVKLRPHGAWINDLMRTEMGEPYRPGEPRLPRGELHVQG

SEQ ID NO: 161 - protein, 732 aa, Artificial Sequence
  Description of Artificial Sequence: Synthetic polypeptide
MAPPHQFQSKPSDVIRRRLSSAVSSKRPNIPGYTSLTPMWAGIAGAVVNNNTQFEVAISIHDSVYNTDFASSVVPYSPNEPEAQAGIIEKHVLETLRKFSTEHMCKFIGAGVTVILLREAPNLCTRLWLDMDIVPIVFNIKPFHTDSITRPNVRHRISSTTGSYVPSGAETPTVYYDPAQLQDPNKLSANVQTRLPIPRTVDEQADSAARKCIMYFGPGNNPRLQIGPRNQVAVDAGGKIHLIDDIDEYRKTVGKGTWNSVIKLADELREKKIKIGFFSSTPQGGGVALMRHAIIRFFTALDVDAAWYVPNPSPSVFRTTKNNHNILQGVADPSLRLTKEAADNFDSWILKNGLRWTAEGGPLAPGGVDIAFIDDPQMPGLIPLIKRIRPDLPIIYRSHIEIRSDLVHVKGSPQEEVWNYLWNNIQHSDLFISHPVNKFVPSDVPLEKLALLGAATDWLDGLSKHLDAWDSQYYMGEFRNLCVKEKMNELGWPAREYIVQIARFDPSKGIPNVIDSYARFRKLCVDKVMEDDIPQLLLCGHGAVDDPDASIIYDQVLQLIHAKYKEYAPDIVVMRCPPSDQLLNTLMANAKFALQLSTREGFEVKVSEALHAGKPVIACRTGGIPLQIEHGKSGYLCEPGDNAAVAQHMLDLYTDEDLYDTMSEYARTHVSDEVGTVGNAAAWMYLAVMYVSRGVKLRPHGAWINDLMRTEMGEPYRPGEPRLPRGELHVQG

SEQ ID NO: 162 - protein, 732 aa, Artificial Sequence
  Description of Artificial Sequence: Synthetic polypeptide
MAPPHQFQSKPSDVIRRRLSSAVSSKRPNIPGYTSLTPMWAGIAGAVVNNNTQFEVAISIHDSVYNTDFASSVVPYSPNEPEAQAGIIEKHVLETLRKFSTEHMCKFLGAGITVILLREAPNLCTRLWLDMDIVPIVFNIKPFHTDSITRPNVRHRISSTTGSYVPSGAETPTVYYDPAQLQDPNKLSANVQTRLPIPRTVDEQADSAARKCIMYFGPGNNPRLQIGPRNQVAVDAGGKIHLIDDIDEYRKTVGKGTWNSVIKLADELREKKIKIGFFSSTPQGGGVALMRHAIIRFFTALDVDAAWYVPNPSPSVFRTTKNNHNILQGVADPSLRLTKEAADNFDSWILKNGLRWTAEGGPLAPGGVDIAFIDDPQMPGLIPLIKRIRPDLPIIYRSHIEIRSDLVHVKGSPQEEVWNYLWNNIQHSDLFISHPVNKFVPSDVPLEKLALLGAATDWLDGLSKHLDAWDSQYYMGEFRNLCVKEKMNELGWPAREYIVQIARFDPSKGIPNVIDSYARFRKLCVDKVMEDDIPQLLLCGHGAVDDPDASIIYDQVLQLIHAKYKEYAPDIVVMRCPPSDQLLNTLMANAKFALQLSTREGFEVKVSEALHAGKPVIACRTGGIPLQIEHGKSGYLCEPGDNAAVAQHMLDLYTDEDLYDTMSEYARTHVSDEVGTVGNAAAWMYLAVMYVSRGVKLRPHGAWINDLMRTEMGEPYRPGEPRLPRGELHVQG

SEQ ID NO: 163 - protein, 732 aa, Artificial Sequence
  Description of Artificial Sequence: Synthetic polypeptide
MAPPHQFQSKPSDVIRRRLSSAVSSKRPNIPGYTSLTPMWAGIAGAVVNNNTQFEVAISIHDSVYNTDFASSVVPYSPNEPEAQAGIIEKHVLETLRKFSTEHMCKFLGAGVTVILLREAPNLCTRLWLDMDIVPIVFNIKPFHTDSITRPNVRHRISSTTGSYVPSGAETPTVYYDPAQLQDPNKLSANVQTRLPIPRTVDEQADSAARKCIMYFGPGNVPRLQIGPRNQVAVDAGGKIHLIDDIDEYRKTVGKGTWNSVIKLADELREKKIKIGFFSSTPQGGGVALMRHAIIRFFTALDVDAAWYVPNPSPSVFRTTKNNHNILQGVADPSLRLTKEAADNFDSWILKNGLRWTAEGGPLAPGGVDIAFIDDPQMPGLIPLIKRIRPDLPIIYRSHIEIRSDLVHVKGSPQEEVWNYLWNNIQHSDLFISHPVNKFVPSDVPLEKLALLGAATDWLDGLSKHLDAWDSQYYMGEFRNLCVKEKMNELGWPAREYIVQIARFDPSKGIPNVIDSYARFRKLCVDKVMEDDIPQLLLCGHGAVDDPDASIIYDQVLQLIHAKYKEYAPDIVVMRCPPSDQLLNTLMANAKFALQLSTREGFEVKVSEALHAGKPVIACRTGGIPLQIEHGKSGYLCEPGDNAAVAQHMLDLYTDEDLYDTMSEYARTHVSDEVGTVGNAAAWMYLAVMYVSRGVKLRPHGAWINDLMRTEMGEPYRPGEPRLPRGELHVQG

SEQ ID NO: 164 - protein, 732 aa, Artificial Sequence
  Description of Artificial Sequence: Synthetic polypeptide
MAPPHQFQSKPSDVIRRRLSSAVSSKRPNIPGYTSLTPMWAGIAGAVVNNNTQFEVAISIHDSVYNTDFASSVVPYSPNEPEAQAGIIEKHVLETLRKFSTEHMCKFLGAGVTVILLREAPNLCTRLWLDMDIVPIVFNIKPFHTDSITRPNVRHRISSTTGSYVPSGAETPTVYYDPAQLQDPNKLSANVQTRLPIPRTVDEQADSAARKCIMYFGPGNNPRLQIGPRNQVAVDAGGKIHLIDDIDEYRKTVGKGTWNSVIKLADELREKKIKIGFFSSTPQGGGVALMRHAIIRFFTILDVDAAWYVPNPSPSVFRTTKNNHNILQGVADPSLRLTKEAADNFDSWILKNGLRWTAEGGPLAPGGVDIAFIDDPQMPGLIPLIKRIRPDLPIIYRSHIEIRSDLVHVKGSPQEEVWNYLWNNIQHSDLFISHPVNKFVPSDVPLEKLALLGAATDWLDGLSKHLDAWDSQYYMGEFRNLCVKEKMNELGWPAREYIVQIARFDPSKGIPNVIDSYARFRKLCVDKVMEDDIPQLLLCGHGAVDDPDASIIYDQVLQLIHAKYKEYAPDIVVMRCPPSDQLLNTLMANAKFALQLSTREGFEVKVSEALHAGKPVIACRTGGIPLQIEHGKSGYLCEPGDNAAVAQHMLDLYTDEDLYDTMSEYARTHVSDEVGTVGNAAAWMYLAVMYVSRGVKLRPHGAWINDLMRTEMGEPYRPGEPRLPRGELHVQG

SEQ ID NO: 165 - protein, 732 aa, Artificial Sequence
  Description of Artificial Sequence: Synthetic polypeptide
MAPPHQFQSKPSDVIRRRLSSAVSSKRPNIPGYTSLTPMWAGIAGAVVNNNTQFEVAISIHDSVYNTDFASSVVPYSPNEPEAQAGIIEKHVLETLRKFSTEHMCKFLGAGVTVILLREAPNLCTRLWLDMDIVPIVFNIKPFHTDSITRPNVRHRISSTTGSYVPSGAETPTVYYDPAQLQDPNKLSANVQTRLPIPRTVDEQADSAARKCIMYFGPGNNPRLQIGPRNQVAVDAGGKIHLIDDIDEYRKTVGKGTWNSVIKLADELREKKIKIGFFSSTPQGGGVALMRHAIIRFFTALDVDAAWYVPNPSPSVFRITKNNHNILQGVADPSLRLTKEAADNFDSWILKNGLRWTAEGGPLAPGGVDIAFIDDPQMPGLIPLIKRIRPDLPIIYRSHIEIRSDLVHVKGSPQEEVWNYLWNNIQHSDLFISHPVNKFVPSDVPLEKLALLGAATDWLDGLSKHLDAWDSQYYMGEFRNLCVKEKMNELGWPAREYIVQIARFDPSKGIPNVIDSYARFRKLCVDKVMEDDIPQLLLCGHGAVDDPDASIIYDQVLQLIHAKYKEYAPDIVVMRCPPSDQLLNTLMANAKFALQLSTREGFEVKVSEALHAGKPVIACRTGGIPLQIEHGKSGYLCEPGDNAAVAQHMLDLYTDEDLYDTMSEYARTHVSDEVGTVGNAAAWMYLAVMYVSRGVKLRPHGAWINDLMRTEMGEPYRPGEPRLPRGELHVQG

SEQ ID NO: 166 - protein, 732 aa, Artificial Sequence
  Description of Artificial Sequence: Synthetic polypeptide
MAPPHQFQSKPSDVIRRRLSSAVSSKRPNIPGYTSLTPMWAGIAGAVVNNNTQFEVAISIHDSVYNTDFASSVVPYSPNEPEAQAGIIEKHVLETLRKFSTEHMCKFLGAGVTVILLREAPNLCTRLWLDMDIVPIVFNIKPFHTDSITRPNVRHRISSTTGSYVPSGAETPTVYYDPAQLQDPNKLSANVQTRLPIPRTVDEQADSAARKCIMYFGPGNNPRLQIGPRNQVAVDAGGKIHLIDDIDEYRKTVGKGTWNSVIKLADELREKKIKIGFFSSTPQGGGVALMRHAIIRFFTALDVDAAWYVPNPSPSVFRTTKNNHNILQGVADPSLRLTKEAADNFDSWILKNGLRWTAEGGPLAPGGVDIAFIDDPQMVGLIPLIKRIRPDLPIIYRSHIEIRSDLVHVKGSPQEEVWNYLWNNIQHSDLFISHPVNKFVPSDVPLEKLALLGAATDWLDGLSKHLDAWDSQYYMGEFRNLCVKEKMNELGWPAREYIVQIARFDPSKGIPNVIDSYARFRKLCVDKVMEDDIPQLLLCGHGAVDDPDASIIYDQVLQLIHAKYKEYAPDIVVMRCPPSDQLLNTLMANAKFALQLSTREGFEVKVSEALHAGKPVIACRTGGIPLQIEHGKSGYLCEPGDNAAVAQHMLDLYTDEDLYDTMSEYARTHVSDEVGTVGNAAAWMYLAVMYVSRGVKLRPHGAWINDLMRTEMGEPYRPGEPRLPRGELHVQG

SEQ ID NO: 167 - protein, 732 aa, Artificial Sequence
  Description of Artificial Sequence: Synthetic polypeptide
MAPPHQFQSKPSDVIRRRLSSAVSSKRPNIPGYTSLTPMWAGIAGAVVNNNTQFEVAISIHDSVYNTDFASSVVPYSPNEPEAQAGIIEKHVLETLRKFSTEHMCKFLGAGVTVILLREAPNLCTRLWLDMDIVPIVFNIKPFHTDSITRPNVRHRISSTTGSYVPSGAETPTVYYDPAQLQDPNKLSANVQTRLPIPRTVDEQADSAARKCIMYFGPGNNPRLQIGPRNQVAVDAGGKIHLIDDIDEYRKTVGKGTWNSVIKLADELREKKIKIGFFSSTPQGGGVALMRHAIIRFFTALDVDAAWYVPNPSPSVFRTTKNNHNILQGVADPSLRLTKEAADNFDSWILKNGLRWTAEGGPLAPGGVDIAFIDDPQMPGLIPLIKRIRPDLPIIYRSHIEIRSDLVHVKGSPQEEVWNYLWNNIQHSDLFISHPVNKFVPSDVPLEKLALLGAATDWLDGLSKHLDAWDSQYYMGEFRNLCVKEKMNELGWPAREYIVQIARFDPSKGIPNVIDSYARFRKLCVDKVMEDDIPQLLLCGHGAVDDPDATIIYDQVLQLIHAKYKEYAPDIVVMRCPPSDQLLNTLMANAKFALQLSTREGFEVKVSEALHAGKPVIACRTGGIPLQIEHGKSGYLCEPGDNAAVAQHMLDLYTDEDLYDTMSEYARTHVSDEVGTVGNAAAWMYLAVMYVSRGVKLRPHGAWINDLMRTEMGEPYRPGEPRLPRGELHVQG

SEQ ID NO: 168 - protein, 732 aa, Artificial Sequence
  Description of Artificial Sequence: Synthetic polypeptide
MAPPHQFQSKPSDVIRRRLSSAVSSKRPNIPGYTSLTPMWAGIAGAVVNNNTQFEVAISIHDSVYNTDFASSVVPYSPNEPEAQAGIIEKHVLETLRKFSTEHMCKFLGAGVTVILLREAPNLCTRLWLDMDIVPIVFNIKPFHTDSITRPNVRHRISSTTGSYVPSGAETPTVYYDPAQLQDPNKLSANVQTRLPIPRTVDEQADSAARKCIMYFGPGNNPRLQIGPRNQVAVDAGGKIHLIDDIDEYRKTVGKGTWNSVIKLADELREKKIKIGFFSSTPQGGGVALMRHAIIRFFTALDVDAAWYVPNPSPSVFRTTKNNHNILQGVADPSLRLTKEAADNFDSWILKNGLRWTAEGGPLAPGGVDIAFIDDPQMPGLIPLIKRIRPDLPIIYRSHIEIRSDLVHVKGSPQEEVWNYLWNNIQHSDLFISHPVNKFVPSDVPLEKLALLGAATDWLDGLSKHLDAWDSQYYMGEFRNLCVKEKMNELGWPAREYIVQIARFDPSKGIPNVIDSYARFRKLCVDKVMEDDIPQLLLCGHGAVDDPDASIIYDQVLELIHAKYKEYAPDIVVMRCPPSDQLLNTLMANAKFALQLSTREGFEVKVSEALHAGKPVIACRTGGIPLQIEHGKSGYLCEPGDNAAVAQHMLDLYTDEDLYDTMSEYARTHVSDEVGTVGNAAAWMYLAVMYVSRGVKLRPHGAWINDLMRTEMGEPYRPGEPRLPRGELHVQG

SEQ ID NO: 169 - protein, 732 aa, Artificial Sequence
  Description of Artificial Sequence: Synthetic polypeptide
MAPPHQFQSKPSDVIRRRLSSAVSSKRPNIPGYTSLTPMWAGIAGAVVNNNTQFEVAISIHDSVYNTDFASSVVPYSPNEPEAQAGIIEKHVLETLRKFSTEHMCKFLGAGVTVILLREAPNLCTRLWLDMDIVPIVFNIKPFHTDSITRPNVRHRISSTTGSYVPSGAETPTVYYDPAQLQDPNKLSANVQTRLPIPRTVDEQADSAARKCIMYFGPGNNPRLQIGPRNQVAVDAGGKIHLIDDIDEYRKTVGKGTWNSVIKLADELREKKIKIGFFSSTPQGGGVALMRHAIIRFFTALDVDAAWYVPNPSPSVFRTTKNNHNILQGVADPSLRLTKEAADNFDSWILKNGLRWTAEGGPLAPGGVDIAFIDDPQMPGLIPLIKRIRPDLPIIYRSHIEIRSDLVHVKGSPQEEVWNYLWNNIQHSDLFISHPVNKFVPSDVPLEKLALLGAATDWLDGLSKHLDAWDSQYYMGEFRNLCVKEKMNELGWPAREYIVQIARFDPSKGIPNVIDSYARFRKLCVDKVMEDDIPQLLLCGHGAVDDPDASIIYDQVLQLIHAKYKEYAPDIVVMRCPPSDQLLNTLMANAKFALQLSTREGFEVKVSEALHAGKPVIACRTGGIPLQIEHGKSGYLCEPGDNEAVAQHMLDLYTDEDLYDTMSEYARTHVSDEVGTVGNAAAWMYLAVMYVSRGVKLRPHGAWINDLMRTEMGEPYRPGEPRLPRGELHVQG

SEQ ID NO: 170 - protein, 732 aa, Artificial Sequence
  Description of Artificial Sequence: Synthetic polypeptide
MAPPHQFQSKPSDVIRRRLSSAVSSKRPNIPGYTSLTPMWAGIAGAVVNNNTQFEVAISIHDSVYNTDFASSVVPYSPNEPEAQAGIIEKHVLETLRKFSTEHMCKFLGAGVTVILLREAPNLCTRLWLDMDIVPIVFNIKPFHTDSITRPNVRHRISSTTGSYVPSGAETPTVYYDPAQLQDPNKLSANVQTRLPIPRTVDEQADSAARKCIMYFGPGNNPRLQIGPRNQVAVDAGGKIHLIDDIDEYRKTVGKGTWNSVIKLADELREKKIKIGFFSSTPQGGGVALMRHAIIRFFTALDVDAAWYVPNPSPSVFRTTKNNHNILQGVADPSLRLTKEAADNFDSWILKNGLRWTAEGGPLAPGGVDIAFIDDPQMPGLIPLIKRIRPDLPIIYRSHIEIRSDLVHVKGSPQEEVWNYLWNNIQHSDLFISHPVNKFVPSDVPLEKLALLGAATDWLDGLSKHLDAWDSQYYMGEFRNLCVKEKMNELGWPAREYIVQIARFDPSKGIPNVIDSYARFRKLCVDKVMEDDIPQLLLCGHGAVDDPDASIIYDQVLQLIHAKYKEYAPDIVVMRCPPSDQLLNTLMANAKFALQLSTREGFEVKVSEALHAGKPVIACRTGGIPLQIEHGKSGYLCEPGDNAAVAQHMLDLYTDEDLYDTMSEYARTHVSDEVGTVGNAAAWMYLAVMYVSRGVKLRPHGAWINDMMRTEMGEPYRPGEPRLPRGELHVQG

SEQ ID NO: 171 - protein, 732 aa, Artificial Sequence
  Description of Artificial Sequence: Synthetic polypeptide
MAPPHQFQSKPSDVIRRRLSSAVSSKRPNIPGYTSLTPMWAGIAGAVVNNNTQFEVAISIHDSVYNTDFASSVVPYSPNEPEAQAGIIEKHVLETLRKFSTEHMCKFIGAGVTVILLREAPNLCTRLWLDMDIVPIVFNIKPFHTDSITRPNVRHRISSTTGSYVPSGAETPTVYYDPAQLQDPNKLSANVQTRLPIPRTVDEQADSAARKCIMYFGPGNVPRLQIGPRNQVAVDAGGKIHLIDDIDEYRKTVGKGTWNSVIKLADELREKKIKIGFFSSTPQGGGVALMRHAIIRFFTALDVDAAWYVPNPSPSVFRTTKNNHNILQGVADPSLRLTKEAADNFDSWILKNGLRWTAEGGPLAPGGVDIAFIDDPQMPGLIPLIKRIRPDLPIIYRSHIEIRSDLVHVKGSPQEEVWNYLWNNIQHSDLFISHPVNKFVPSDVPLEKLALLGAATDWLDGLSKHLDAWDSQYYMGEFRNLCVKEKMNELGWPAREYIVQIARFDPSKGIPNVIDSYARFRKLCVDKVMEDDIPQLLLCGHGAVDDPDASIIYDQVLQLIHAKYKEYAPDIVVMRCPPSDQLLNTLMANAKFALQLSTREGFEVKVSEALHAGKPVIACRTGGIPLQIEHGKSGYLCEPGDNAAVAQHMLDLYTDEDLYDTMSEYARTHVSDEVGTVGNAAAWMYLAVMYVSRGVKLRPHGAWINDLMRTEMGEPYRPGEPRLPRGELHVQG

SEQ ID NO: 172 - protein, 732 aa, Artificial Sequence
  Description of Artificial Sequence: Synthetic polypeptide
MAPPHQFQSKPSDVIRRRLSSAVSSKRPNIPGYTSLTPMWAGIAGAVVNNNTQFEVAISIHDSVYNTDFASSVVPYSPNEPEAQAGIIEKHVLETLRKFSTEHMCKFIGAGVTVILLREAPNLCTRLWLDMDIVPIVFNIKPFHTDSITRPNVRHRISSTTGSYVPSGAETPTVYYDPAQLQDPNKLSANVQTRLPIPRTVDEQADSAARKCIMYFGPGNNPRLQIGPRNQVAVDAGGKIHLIDDIDEYRKTVGKGTWNSVIKLADELREKKIKIGFFSSTPQGGGVALMRHAIIRFFTILDVDAAWYVPNPSPSVFRTTKNNHNILQGVADPSLRLTKEAADNFDSWILKNGLRWTAEGGPLAPGGVDIAFIDDPQMPGLIPLIKRIRPDLPIIYRSHIEIRSDLVHVKGSPQEEVWNYLWNNIQHSDLFISHPVNKFVPSDVPLEKLALLGAATDWLDGLSKHLDAWDSQYYMGEFRNLCVKEKMNELGWPAREYIVQIARFDPSKGIPNVIDSYARFRKLCVDKVMEDDIPQLLLCGHGAVDDPDASIIYDQVLQLIHAKYKEYAPDIVVMRCPPSDQLLNTLMANAKFALQLSTREGFEVKVSEALHAGKPVIACRTGGIPLQIEHGKSGYLCEPGDNAAVAQHMLDLYTDEDLYDTMSEYARTHVSDEVGTVGNAAAWMYLAVMYVSRGVKLRPHGAWINDLMRTEMGEPYRPGEPRLPRGELHVQG

SEQ ID NO: 173 - protein, 732 aa, Artificial Sequence
  Description of Artificial Sequence: Synthetic polypeptide
MAPPHQFQSKPSDVIRRRLSSAVSSKRPNIPGYTSLTPMWAGIAGAVVNNNTQFEVAISIHDSVYNTDFASSVVPYSPNEPEAQAGIIEKHVLETLRKFSTEHMCKFIGAGVTVILLREAPNLCTRLWLDMDIVPIVFNIKPFHTDSITRPNVRHRISSTTGSYVPSGAETPTVYYDPAQLQDPNKLSANVQTRLPIPRTVDEQADSAARKCIMYFGPGNNPRLQIGPRNQVAVDAGGKIHLIDDIDEYRKTVGKGTWNSVIKLADELREKKIKIGFFSSTPQGGGVALMRHAIIRFFTALDVDAAWYVPNPSPSVFRITKNNHNILQGVADPSLRLTKEAADNFDSWILKNGLRWTAEGGPLAPGGVDIAFIDDPQMPGLIPLIKRIRPDLPIIYRSHIEIRSDLVHVKGSPQEEVWNYLWNNIQHSDLFISHPVNKFVPSDVPLEKLALLGAATDWLDGLSKHLDAWDSQYYMGEFRNLCVKEKMNELGWPAREYIVQIARFDPSKGIPNVIDSYARFRKLCVDKVMEDDIPQLLLCGHGAVDDPDASIIYDQVLQLIHAKYKEYAPDIVVMRCPPSDQLLNTLMANAKFALQLSTREGFEVKVSEALHAGKPVIACRTGGIPLQIEHGKSGYLCEPGDNAAVAQHMLDLYTDEDLYDTMSEYARTHVSDEVGTVGNAAAWMYLAVMYVSRGVKLRPHGAWINDLMRTEMGEPYRPGEPRLPRGELHVQG

SEQ ID NO: 174 - protein, 732 aa, Artificial Sequence
  Description of Artificial Sequence: Synthetic polypeptide
MAPPHQFQSKPSDVIRRRLSSAVSSKRPNIPGYTSLTPMWAGIAGAVVNNNTQFEVAISIHDSVYNTDFASSVVPYSPNEPEAQAGIIEKHVLETLRKFSTEHMCKFIGAGVTVILLREAPNLCTRLWLDMDIVPIVFNIKPFHTDSITRPNVRHRISSTTGSYVPSGAETPTVYYDPAQLQDPNKLSANVQTRLPIPRTVDEQADSAARKCIMYFGPGNNPRLQIGPRNQVAVDAGGKIHLIDDIDEYRKTVGKGTWNSVIKLADELREKKIKIGFFSSTPQGGGVALMRHAIIRFFTALDVDAAWYVPNPSPSVFRTTKNNHNILQGVADPSLRLTKEAADNFDSWILKNGLRWTAEGGPLAPGGVDIAFIDDPQMPGLIPLIKRIRPDLPIIYRSHIEIRSDLVHVKGSPQEEVWNYLWNNIQHSDLFISHPVNKFVPSDVPLEKLALLGAATDWLDGLSKHLDAWDSQYYMGEFRNLCAKEKMNELGWPAREYIVQIARFDPSKGIPNVIDSYARFRKLCVDKVMEDDIPQLLLCGHGAVDDPDASIIYDQVLQLIHAKYKEYAPDIVVMRCPPSDQLLNTLMANAKFALQLSTREGFEVKVSEALHAGKPVIACRTGGIPLQIEHGKSGYLCEPGDNAAVAQHMLDLYTDEDLYDTMSEYARTHVSDEVGTVGNAAAWMYLAVMYVSRGVKLRPHGAWINDLMRTEMGEPYRPGEPRLPRGELHVQG

SEQ ID NO: 175 - protein, 732 aa, Artificial Sequence
  Description of Artificial Sequence: Synthetic polypeptide
MAPPHQFQSKPSDVIRRRLSSAVSSKRPNIPGYTSLTPMWAGIAGAVVNNNTQFEVAISIHDSVYNTDFASSVVPYSPNEPEAQAGIIEKHVLETLRKFSTEHMCKFIGAGVTVILLREAPNLCTRLWLDMDIVPIVFNIKPFHTDSITRPNVRHRISSTTGSYVPSGAETPTVYYDPAQLQDPNKLSANVQTRLPIPRTVDEQADSAARKCIMYFGPGNNPRLQIGPRNQVAVDAGGKIHLIDDIDEYRKTVGKGTWNSVIKLADELREKKIKIGFFSSTPQGGGVALMRHAIIRFFTALDVDAAWYVPNPSPSVFRTTKNNHNILQGVADPSLRLTKEAADNFDSWILKNGLRWTAEGGPLAPGGVDIAFIDDPQMPGLIPLIKRIRPDLPIIYRSHIEIRSDLVHVKGSPQEEVWNYLWNNIQHSDLFISHPVNKFVPSDVPLEKLALLGAATDWLDGLSKHLDAWDSQYYMGEFRNLCVKEKMNELGWPAREYIVQIARFDPSKGIPNVIDSYARFRKLCVDKVMEDDIPQLLLCGHGAVDDPDATIIYDQVLQLIHAKYKEYAPDIVVMRCPPSDQLLNTLMANAKFALQLSTREGFEVKVSEALHAGKPVIACRTGGIPLQIEHGKSGYLCEPGDNAAVAQHMLDLYTDEDLYDTMSEYARTHVSDEVGTVGNAAAWMYLAVMYVSRGVKLRPHGAWINDLMRTEMGEPYRPGEPRLPRGELHVQG

SEQ ID NO: 176 - protein, 732 aa, Artificial Sequence
  Description of Artificial Sequence: Synthetic polypeptide
MAPPHQFQSKPSDVIRRRLSSAVSSKRPNIPGYTSLTPMWAGIAGAVVNNNTQFEVAISIHDSVYNTDFASSVVPYSPNEPEAQAGIIEKHVLETLRKFSTEHMCKFIGAGVTVILLREAPNLCTRLWLDMDIVPIVFNIKPFHTDSITRPNVRHRISSTTGSYVPSGAETPTVYYDPAQLQDPNKLSANVQTRLPIPRTVDEQADSAARKCIMYFGPGNNPRLQIGPRNQVAVDAGGKIHLIDDIDEYRKTVGKGTWNSVIKLADELREKKIKIGFFSSTPQGGGVALMRHAIIRFFTALDVDAAWYVPNPSPSVFRTTKNNHNILQGVADPSLRLTKEAADNFDSWILKNGLRWTAEGGPLAPGGVDIAFIDDPQMVGLIPLIKRIRPDLPIIYRSHIEIRSDLVHVKGSPQEEVWNYLWNNIQHSDLFISHPVNKFVPSDVPLEKLALLGAATDWLDGLSKHLDAWDSQYYMGEFRNLCVKEKMNELGWPAREYIVQIARFDPSKGIPNVIDSYARFRKLCVDKVMEDDIPQLLLCGHGAVDDPDASIIYDQVLQLIHAKYKEYAPDIVVMRCPPSDQLLNTLMANAKFALQLSTREGFEVKVSEALHAGKPVIACRTGGIPLQIEHGKSGYLCEPGDNAAVAQHMLDLYTDEDLYDTMSEYARTHVSDEVGTVGNAAAWMYLAVMYVSRGVKLRPHGAWINDLMRTEMGEPYRPGEPRLPRGELHVQG

SEQ ID NO: 177 - protein, 732 aa, Artificial Sequence
  Description of Artificial Sequence: Synthetic polypeptide
MAPPHQFQSKPSDVIRRRLSSAVSSKRPNIPGYTSLTPMWAGIAGAVVNNNTQFEVAISIHDSVYNTDFASSVVPYSPNEPEAQAGIIEKHVLETLRKFSTEHMCKFLGAGITVILLREAPNLCTRLWLDMDIVPIVFNIKPFHTDSITRPNVRHRISSTTGSYVPSGAETPTVYYDPAQLQDPNKLSANVQTRLPIPRTVDEQADSAARKCIMYFGPGNNPRLQIGPRNQVAVDAGGKIHLIDDIDEYRKTVGKGTWNSVIKLADELREKKIKIGFFSSTPQGGGVALMRHAIIRFFTALDVDAAWYVPNPSPSVFRTTKNNHNILQGVADPSLRLTKEAADNFDSWILKNGLRWTAEGGPLAPGGVDIAFIDDPQMVGLIPLIKRIRPDLPIIYRSHIEIRSDLVHVKGSPQEEVWNYLWNNIQHSDLFISHPVNKFVPSDVPLEKLALLGAATDWLDGLSKHLDAWDSQYYMGEFRNLCVKEKMNELGWPAREYIVQIARFDPSKGIPNVIDSYARFRKLCVDKVMEDDIPQLLLCGHGAVDDPDASIIYDQVLQLIHAKYKEYAPDIVVMRCPPSDQLLNTLMANAKFALQLSTREGFEVKVSEALHAGKPVIACRTGGIPLQIEHGKSGYLCEPGDNAAVAQHMLDLYTDEDLYDTMSEYARTHVSDEVGTVGNAAAWMYLAVMYVSRGVKLRPHGAWINDLMRTEMGEPYRPGEPRLPRGELHVQG

SEQ ID NO: 178 - protein, 732 aa, Artificial Sequence
  Description of Artificial Sequence: Synthetic polypeptide
MAPPHQFQSKPSDVIRRRLSSAVSSKRPNIPGYTSLTPMWAGIAGAVVNNNTQFEVAISIHDSVYNTDFASSVVPYSPNEPEAQAGIIEKHVLETLRKFSTEHMCKFLGAGVTVILLREAPNLCTRLWLDMDIVPIVFNIKPFHTDSITRPNVRHRISSTTGSYVPSGAETPTVYYDPAQLQDPNKLSANVQTRLPIPRTVDEQADSAARKCIMYFGPGNVPRLQIGPRNQVAVDAGGKIHLIDDIDEYRKTVGKGTWNSVIKLADELREKKIKIGFFSSTPQGGGVALMRHAIIRFFTALDVDAAWYVPNPSPSVFRTTKNNHNILQGVADPSLRLTKEAADNFDSWILKNGLRWTAEGGPLAPGGVDIAFIDDPQMVGLIPLIKRIRPDLPIIYRSHIEIRSDLVHVKGSPQEEVWNYLWNNIQHSDLFISHPVNKFVPSDVPLEKLALLGAATDWLDGLSKHLDAWDSQYYMGEFRNLCVKEKMNELGWPAREYIVQIARFDPSKGIPNVIDSYARFRKLCVDKVMEDDIPQLLLCGHGAVDDPDASIIYDQVLQLIHAKYKEYAPDIVVMRCPPSDQLLNTLMANAKFALQLSTREGFEVKVSEALHAGKPVIACRTGGIPLQIEHGKSGYLCEPGDNAAVAQHMLDLYTDEDLYDTMSEYARTHVSDEVGTVGNAAAWMYLAVMYVSRGVKLRPHGAWINDLMRTEMGEPYRPGEPRLPRGELHVQG

SEQ ID NO: 179 - protein, 732 aa, Artificial Sequence
  Description of Artificial Sequence: Synthetic polypeptide
MAPPHQFQSKPSDVIRRRLSSAVSSKRPNIPGYTSLTPMWAGIAGAVVNNNTQFEVAISIHDSVYNTDFASSVVPYSPNEPEAQAGIIEKHVLETLRKFSTEHMCKFLGAGVTVILLREAPNLCTRLWLDMDIVPIVFNIKPFHTDSITRPNVRHRISSTTGSYVPSGAETPTVYYDPAQLQDPNKLSANVQTRLPIPRTVDEQADSAARKCIMYFGPGNNPRLQIGPRNQVAVDAGGKIHLIDDIDEYRKTVGKGTWNSVIKLADELREKKIKIGFFSSTPQGGGVALMRHAIIRFFTILDVDAAWYVPNPSPSVFRTTKNNHNILQGVADPSLRLTKEAADNFDSWILKNGLRWTAEGGPLAPGGVDIAFIDDPQMVGLIPLIKRIRPDLPIIYRSHIEIRSDLVHVKGSPQEEVWNYLWNNIQHSDLFISHPVNKFVPSDVPLEKLALLGAATDWLDGLSKHLDAWDSQYYMGEFRNLCVKEKMNELGWPAREYIVQIARFDPSKGIPNVIDSYARFRKLCVDKVMEDDIPQLLLCGHGAVDDPDASIIYDQVLQLIHAKYKEYAPDIVVMRCPPSDQLLNTLMANAKFALQLSTREGFEVKVSEALHAGKPVIACRTGGIPLQIEHGKSGYLCEPGDNAAVAQHMLDLYTDEDLYDTMSEYARTHVSDEVGTVGNAAAWMYLAVMYVSRGVKLRPHGAWINDLMRTEMGEPYRPGEPRLPRGELHVQG

SEQ ID NO: 180 - protein, 732 aa, Artificial Sequence
  Description of Artificial Sequence: Synthetic polypeptide
MAPPHQFQSKPSDVIRRRLSSAVSSKRPNIPGYTSLTPMWAGIAGAVVNNNTQFEVAISIHDSVYNTDFASSVVPYSPNEPEAQAGIIEKHVLETLRKFSTEHMCKFLGAGVTVILLREAPNLCTRLWLDMDIVPIVFNIKPFHTDSITRPNVRHRISSTTGSYVPSGAETPTVYYDPAQLQDPNKLSANVQTRLPIPRTVDEQADSAARKCIMYFGPGNNPRLQIGPRNQVAVDAGGKIHLIDDIDEYRKTVGKGTWNSVIKLADELREKKIKIGFFSSTPQGGGVALMRHAIIRFFTALDVDAAWYVPNPSPSVFRITKNNHNILQGVADPSLRLTKEAADNFDSWILKNGLRWTAEGGPLAPGGVDIAFIDDPQMVGLIPLIKRIRPDLPIIYRSHIEIRSDLVHVKGSPQEEVWNYLWNNIQHSDLFISHPVNKFVPSDVPLEKLALLGAATDWLDGLSKHLDAWDSQYYMGEFRNLCVKEKMNELGWPAREYIVQIARFDPSKGIPNVIDSYARFRKLCVDKVMEDDIPQLLLCGHGAVDDPDASIIYDQVLQLIHAKYKEYAPDIVVMRCPPSDQLLNTLMANAKFALQLSTREGFEVKVSEALHAGKPVIACRTGGIPLQIEHGKSGYLCEPGDNAAVAQHMLDLYTDEDLYDTMSEYARTHVSDEVGTVGNAAAWMYLAVMYVSRGVKLRPHGAWINDLMRTEMGEPYRPGEPRLPRGELHVQG

SEQ ID NO: 181 - protein, 732 aa, Artificial Sequence
  Description of Artificial Sequence: Synthetic polypeptide
MAPPHQFQSKPSDVIRRRLSSAVSSKRPNIPGYTSLTPMWAGIAGAVVNNNTQFEVAISIHDSVYNTDFASSVVPYSPNEPEAQAGIIEKHVLETLRKFSTEHMCKFLGAGVTVILLREAPNLCTRLWLDMDIVPIVFNIKPFHTDSITRPNVRHRISSTTGSYVPSGAETPTVYYDPAQLQDPNKLSANVQTRLPIPRTVDEQADSAARKCIMYFGPGNNPRLQIGPRNQVAVDAGGKIHLIDDIDEYRKTVGKGTWNSVIKLADELREKKIKIGFFSSTPQGGGVALMRHAIIRFFTALDVDAAWYVPNPSPSVFRTTKNNHNILQGVADPSLRLTKEAADNYDSWILKNGLRWTAEGGPLAPGGVDIAFIDDPQMVGLIPLIKRIRPDLPIIYRSHIEIRSDLVHVKGSPQEEVWNYLWNNIQHSDLFISHPVNKFVPSDVPLEKLALLGAATDWLDGLSKHLDAWDSQYYMGEFRNLCVKEKMNELGWPAREYIVQIARFDPSKGIPNVIDSYARFRKLCVDKVMEDDIPQLLLCGHGAVDDPDASIIYDQVLQLIHAKYKEYAPDIVVMRCPPSDQLLNTLMANAKFALQLSTREGFEVKVSEALHAGKPVIACRTGGIPLQIEHGKSGYLCEPGDNAAVAQHMLDLYTDEDLYDTMSEYARTHVSDEVGTVGNAAAWMYLAVMYVSRGVKLRPHGAWINDLMRTEMGEPYRPGEPRLPRGELHVQG

SEQ ID NO: 182 - protein, 732 aa, Artificial Sequence
  Description of Artificial Sequence: Synthetic polypeptide
MAPPHQFQSKPSDVIRRRLSSAVSSKRPNIPGYTSLTPMWAGIAGAVVNNNTQFEVAISIHDSVYNTDFASSVVPYSPNEPEAQAGIIEKHVLETLRKFSTEHMCKFLGAGVTVILLREAPNLCTRLWLDMDIVPIVFNIKPFHTDSITRPNVRHRISSTTGSYVPSGAETPTVYYDPAQLQDPNKLSANVQTRLPIPRTVDEQADSAARKCIMYFGPGNNPRLQIGPRNQVAVDAGGKIHLIDDIDEYRKTVGKGTWNSVIKLADELREKKIKIGFFSSTPQGGGVALMRHAIIRFFTALDVDAAWYVPNPSPSVFRTTKNNHNILQGVADPSLRLTKEAADNFDSWILKNGLRWTAEGGPLAPGGVDIAFIDDPQMVGLIPLIKRIRPDLPIIYRSHIEIRSDLVHVKGSPQEEVWNYLWNNIQHSDLFISHPVNKFVPSDVPLEKLALLGAATDWLDGLSKHLDAWDSQYYMGEFRNLCAKEKMNELGWPAREYIVQIARFDPSKGIPNVIDSYARFRKLCVDKVMEDDIPQLLLCGHGAVDDPDASIIYDQVLQLIHAKYKEYAPDIVVMRCPPSDQLLNTLMANAKFALQLSTREGFEVKVSEALHAGKPVIACRTGGIPLQIEHGKSGYLCEPGDNAAVAQHMLDLYTDEDLYDTMSEYARTHVSDEVGTVGNAAAWMYLAVMYVSRGVKLRPHGAWINDLMRTEMGEPYRPGEPRLPRGELHVQG

SEQ ID NO: 183 - protein, 732 aa, Artificial Sequence
  Description of Artificial Sequence: Synthetic polypeptide
MAPPHQFQSKPSDVIRRRLSSAVSSKRPNIPGYTSLTPMWAGIAGAVVNNNTQFEVAISIHDSVYNTDFASSVVPYSPNEPEAQAGIIEKHVLETLRKFSTEHMCKFLGAGVTVILLREAPNLCTRLWLDMDIVPIVFNIKPFHTDSITRPNVRHRISSTTGSYVPSGAETPTVYYDPAQLQDPNKLSANVQTRLPIPRTVDEQADSAARKCIMYFGPGNNPRLQIGPRNQVAVDAGGKIHLIDDIDEYRKTVGKGTWNSVIKLADELREKKIKIGFFSSTPQGGGVALMRHAIIRFFTALDVDAAWYVPNPSPSVFRTTKNNHNILQGVADPSLRLTKEAADNFDSWILKNGLRWTAEGGPLAPGGVDIAFIDDPQMVGLIPLIKRIRPDLPIIYRSHIEIRSDLVHVKGSPQEEVWNYLWNNIQHSDLFISHPVNKFVPSDVPLEKLALLGAATDWLDGLSKHLDAWDSQYYMGEFRNLCVKEKMNELGWPAREYIVQIARFDPSKGIPNVIDSYARFRKLCVDKVMEDDIPQLLLCGHGAIDDPDASIIYDQVLQLIHAKYKEYAPDIVVMRCPPSDQLLNTLMANAKFALQLSTREGFEVKVSEALHAGKPVIACRTGGIPLQIEHGKSGYLCEPGDNAAVAQHMLDLYTDEDLYDTMSEYARTHVSDEVGTVGNAAAWMYLAVMYVSRGVKLRPHGAWINDLMRTEMGEPYRPGEPRLPRGELHVQG

SEQ ID NO: 184 - protein, 732 aa, Artificial Sequence
  Description of Artificial Sequence: Synthetic polypeptide
MAPPHQFQSKPSDVIRRRLSSAVSSKRPNIPGYTSLTPMWAGIAGAVVNNNTQFEVAISIHDSVYNTDFASSVVPYSPNEPEAQAGIIEKHVLETLRKFSTEHMCKFLGAGVTVILLREAPNLCTRLWLDMDIVPIVFNIKPFHTDSITRPNVRHRISSTTGSYVPSGAETPTVYYDPAQLQDPNKLSANVQTRLPIPRTVDEQADSAARKCIMYFGPGNNPRLQIGPRNQVAVDAGGKIHLIDDIDEYRKTVGKGTWNSVIKLADELREKKIKIGFFSSTPQGGGVALMRHAIIRFFTALDVDAAWYVPNPSPSVFRTTKNNHNILQGVADPSLRLTKEAADNFDSWILKNGLRWTAEGGPLAPGGVDIAFIDDPQMVGLIPLIKRIRPDLPIIYRSHIEIRSDLVHVKGSPQEEVWNYLWNNIQHSDLFISHPVNKFVPSDVPLEKLALLGAATDWLDGLSKHLDAWDSQYYMGEFRNLCVKEKMNELGWPAREYIVQIARFDPSKGIPNVIDSYARFRKLCVDKVMEDDIPQLLLCGHGAVDDPDATIIYDQVLQLIHAKYKEYAPDIVVMRCPPSDQLLNTLMANAKFALQLSTREGFEVKVSEALHAGKPVIACRTGGIPLQIEHGKSGYLCEPGDNAAVAQHMLDLYTDEDLYDTMSEYARTHVSDEVGTVGNAAAWMYLAVMYVSRGVKLRPHGAWINDLMRTEMGEPYRPGEPRLPRGELHVQG

SEQ ID NO: 185 - protein, 732 aa, Artificial Sequence
  Description of Artificial Sequence: Synthetic polypeptide
MAPPHQFQSKPSDVIRRRLSSAVSSKRPNIPGYTSLTPMWAGIAGAVVNNNTQFEVAISIHDSVYNTDFASSVVPYSPNEPEAQAGIIEKHVLETLRKFSTEHMCKFLGAGVTVILLREAPNLCTRLWLDMDIVPIVFNIKPFHTDSITRPNVRHRISSTTGSYVPSGAETPTVYYDPAQLQDPNKLSANVQTRLPIPRTVDEQADSAARKCIMYFGPGNNPRLQIGPRNQVAVDAGGKIHLIDDIDEYRKTVGKGTWNSVIKLADELREKKIKIGFFSSTPQGGGVALMRHAIIRFFTALDVDAAWYVPNPSPSVFRTTKNNHNILQGVADPSLRLTKEAADNFDSWILKNGLRWTAEGGPLAPGGVDIAFIDDPQMVGLIPLIKRIRPDLPIIYRSHIEIRSDLVHVKGSPQEEVWNYLWNNIQHSDLFISHPVNKFVPSDVPLEKLALLGAATDWLDGLSKHLDAWDSQYYMGEFRNLCAKEKMNELGWPAREYIVQIARFDPSKGIPNVIDSYARFRKLCVDKVMEDDIPQLLLCGHGAVDDPDASIIYDQVLELIHAKYKEYAPDIVVMRCPPSDQLLNTLMANAKFALQLSTREGFEVKVSEALHAGKPVIACRTGGIPLQIEHGKSGYLCEPGDNAAVAQHMLDLYTDEDLYDTMSEYARTHVSDEVGTVGNAAAWMYLAVMYVSRGVKLRPHGAWINDLMRTEMGEPYRPGEPRLPRGELHVQG

SEQ ID NO: 186 - protein, 732 aa, Artificial Sequence
  Description of Artificial Sequence: Synthetic polypeptide
MAPPHQFQSKPSDVIRRRLSSAVSSKRPNIPGYTSLTPMWAGIAGAVVNNNTQFEVAISIHDSVYNTDFASSVVPYSPNEPEAQAGIIEKHVLETLRKFSTEHMCKFLGAGVTVILLREAPNLCTRLWLDMDIVPIVFNIKPFHTDSITRPNVRHRISSTTGSYVPSGAETPTVYYDPAQLQDPNKLSANVQTRLPIPRTVDEQADSAARKCIMYFGPGNNPRLQIGPRNQVAVDAGGKIHLIDDIDEYRKTVGKGTWNSVIKLADELREKKIKIGFFSSTPQGGGVALMRHAIIRFFTALDVDAAWYVPNPSPSVFRTTKNNHNILQGVADPSLRLTKEAADNFDSWILKNGLRWTAEGGPLAPGGVDIAFIDDPQMVGLIPLIKRIRPDLPIIYRSHIEIRSDLVHVKGSPQEEVWNYLWNNIQHSDLFISHPVNKFVPSDVPLEKLALLGAATDWLDGLSKHLDAWDSQYYMGEFRNLCVKEKMNELGWPAREYIVQIARFDPSKGIPNVIDSYARFRKLCVDKVMEDDIPQLLLCGHGAIDDPDATIIYDQVLQLIHAKYKEYAPDIVVMRCPPSDQLLNTLMANAKFALQLSTREGFEVKVSEALHAGKPVIACRTGGIPLQIEHGKSGYLCEPGDNAAVAQHMLDLYTDEDLYDTMSEYARTHVSDEVGTVGNAAAWMYLAVMYVSRGVKLRPHGAWINDLMRTEMGEPYRPGEPRLPRGELHVQG

SEQ ID NO: 187 - protein, 732 aa, Artificial Sequence
  Description of Artificial Sequence: Synthetic polypeptide
MAPPHQFQSKPSDVIRRRLSSAVSSKRPNIPGYTSLTPMWAGIAGAVVNNNTQFEVAISIHDSVYNTDFASSVVPYSPNEPEAQAGIIEKHVLETLRKFSTEHMCKFLGAGVTVILLREAPNLCTRLWLDMDIVPIVFNIKPFHTDSITRPNVRHRISSTTGSYVPSGAETPTVYYDPAQLQDPNKLSANVQTRLPIPRTVDEQADSAARKCIMYFGPGNNPRLQIGPRNQVAVDAGGKIHLIDDIDEYRKTVGKGTWNSVIKLADELREKKIKIGFFSSTPQGGGVALMRHAIIRFFTALDVDAAWYVPNPSPSVFRTTKNNHNILQGVADPSLRLTKEAADNFDSWILKNGLRWTAEGGPLAPGGVDIAFIDDPQMVGLIPLIKRIRPDLPIIYRSHIEIRSDLVHVKGSPQEEVWNYLWNNIQHSDLFISHPVNKFVPSDVPLEKLALLGAATDWLDGLSKHLDAWDSQYYMGEFRNLCVKEKMNELGWPAREYIVQIARFDPSKGIPNVIDSYARFRKLCVDKVMEDDIPQLLLCGHGAIDDPDASIIYDQVLELIHAKYKEYAPDIVVMRCPPSDQLLNTLMANAKFALQLSTREGFEVKVSEALHAGKPVIACRTGGIPLQIEHGKSGYLCEPGDNAAVAQHMLDLYTDEDLYDTMSEYARTHVSDEVGTVGNAAAWMYLAVMYVSRGVKLRPHGAWINDLMRTEMGEPYRPGEPRLPRGELHVQG

SEQ ID NO: 188 - protein, 732 aa, Artificial Sequence
  Description of Artificial Sequence: Synthetic polypeptide
MAPPHQFQSKPSDVIRRRLSSAVSSKRPNIPGYTSLTPMWAGIAGAVVNNNTQFEVAISIHDSVYNTDFASSVVPYSPNEPEAQAGIIEKHVLETLRKFSTEHMCKFLGAGVTVILLREAPNLCTRLWLDMDIVPIVFNIKPFHTDSITRPNVRHRISSTTGSYVPSGAETPTVYYDPAQLQDPNKLSANVQTRLPIPRTVDEQADSAARKCIMYFGPGNNPRLQIGPRNQVAVDAGGKIHLIDDIDEYRKTVGKGTWNSVIKLADELREKKIKIGFFSSTPQGGGVALMRHAIIRFFTALDVDAAWYVPNPSPSVFRTTKNNHNILQGVADPSLRLTKEAADNFDSWILKNGLRWTAEGGPLAPGGVDIAFIDDPQMVGLIPLIKRIRPDLPIIYRSHIEIRSDLVHVKGSPQEEVWNYLWNNIQHSDLFISHPVNKFVPSDVPLEKLALLGAATDWLDGLSKHLDAWDSQYYMGEFRNLCVKEKMNELGWPAREYIVQIARFDPSKGIPNVIDSYARFRKLCVDKVMEDDIPQLLLCGHGAVDDPDATIIYDQVLELIHAKYKEYAPDIVVMRCPPSDQLLNTLMANAKFALQLSTREGFEVKVSEALHAGKPVIACRTGGIPLQIEHGKSGYLCEPGDNAAVAQHMLDLYTDEDLYDTMSEYARTHVSDEVGTVGNAAAWMYLAVMYVSRGVKLRPHGAWINDLMRTEMGEPYRPGEPRLPRGELHVQG

SEQ ID NO: 189 - protein, 732 aa, Artificial Sequence
  Description of Artificial Sequence: Synthetic polypeptide
MAPPHQFQSKPSDVIRRRLSSAVSSKRPNIPGYTSLTPMWAGIAGAVVNNNTQFEVAISIHDSVYNTDFASSVVPYSPNEPEAQAGIIEKHVLETLRKFSTEHMCKFLGAGVTVILLREAPNLCTRLWLDMDIVPIVFNIKPFHTDSITRPNVRHRISSTTGSYVPSGAETPTVYYDPAQLQDPNKLSANVQTRLPIPRTVDEQADSAARKCIMYFGPGNNPRLQIGPRNQVAVDAGGKIHLIDDIDEYRKTVGKGTWNSVIKLADELREKKIKIGFFSSTPQGGGVALMRHAIIRFFTALDVDAAWYVPNPSPSVFRTTKNNHNILQGVADPSLRLTKEAADNFDSWILKNGLRWTAEGGPLAPGGVDIAFIDDPQMVGLIPLIKRIRPDLPIIYRSHIEIRSDLVHVKGSPQEEVWNYLWNNIQHSDLFISHPVNKFVPSDVPLEKLALLGAATDWLDGLSKHLDAWDSQYYMGEFRNLCAKEKMNELGWPAREYIVQIARFDPSKGIPNVIDSYARFRKLCVDKVMEDDIPQLLLCGHGAIDDPDASIIYDQVLELIHAKYKEYAPDIVVMRCPPSDQLLNTLMANAKFALQLSTREGFEVKVSEALHAGKPVIACRTGGIPLQIEHGKSGYLCEPGDNAAVAQHMLDLYTDEDLYDTMSEYARTHVSDEVGTVGNAAAWMYLAVMYVSRGVKLRPHGAWINDLMRTEMGEPYRPGEPRLPRGELHVQG

SEQ ID NO: 190 - protein, 737 aa, Artificial Sequence
  Description of Artificial Sequence: Synthetic polypeptide
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNVPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRITKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCLKDKMNTLDWPNREYCIQIARFDPAKGIPNVIDSYARFRRLLNEAGDVDADDQPQLLICGHGAIDDPDATIIYDQVLELIHEKYAEFAKDIVVMRLPPSDQLLNCLMANARIALQLSTREGFEVKVSEAVHAGKPIIAATTGGIPLQVEHGKSGFLTEPGDNEQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 191 - protein, 737 aa, Schizophyllum commune H4-8
  XP_003035156.1 glycosyltransferase family 4 protein [Schizophyllum commune H4-8] EFJ00254.1 glycosyltransferase family 4 protein [Schizophyllum commune H4-8]
MSPPHGFSSKPSTAARRRLSSKASLTNRPTFSKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDVAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVEPDDQPQLLICGHGAVDDPDASIIYDQVLTLIHEKYAEFAKDIVVMRLPPSDQLLDCLMANARIALQLSTREGFEVKVSEAIHAGKPIIAATTGGIPLQVEHGKSGFLTEPGDNVQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 192 - protein, 626 aa, Trametes cinnabarina
  CDO74881.1 Glycosyltransferase Family 4 protein [Trametes cinnabarina]
MPAIGSRQANLAQAPNLCTRLWLELDIVPIVFNIKPYHTDSITRPNIRHRISSTTGSYVPSGAETPTVYYDPSQLPGAQANLTATQNKLPIPRTVDEQADSAARKCIMYFGPSNNPRLTIGPRNQVAVDAGGKIHLIDDIDEYRKGVGKGTWNCVNKLADELREKKIKMAFFSSTPQGGGVALMRHALIRFLNLLDVDCAWYVPNPSPTVFRTTKNNHNILQGVADPNLRLTKEAKDNFDAWILKNGLRWTAEGGPLAPGGVDIAFIDDPQMPGLIPLIRRVRPDLPIIYRSHIEIRSDLVHVAGSPQEEVWKYLWNNIQHADMFISHPVNKFVPSDVPTDKLALLGAATDWLDGLNKPLDQWDLQYYMGEFRSLCVKEKMTELGWPAREYIVQIARFDPSKGIPNVIDSYARFRKLLAEKEPDIEPPQMLICGHGAVDDPDASIIYDQTMQLIHNKYAQYAGDFVVMRCPPSDQLLNALMENSKFALQLSTREGFEVKVSEALHAGKPVIASRTGGIPLQIEHGKSGYLCEPGDNAAVAQHMFDLYTDDDLFDQMSEYARTHVSDEVSTVGNATAWMYLAVMYCSRGVRLQPNGAWLNDLMRTECGEPYQPGEPRLPRGGLNVQG

SEQ ID NO: 193 - protein, 735 aa, Hypsizygus marmoreus
  KYQ39707.1 Trehalose phosphorylase [Hypsizygus marmoreus]
MAPYHQFESKPSLAMRRRLSSSVSTRPEVTATFASLTPMWAGIAGNPISNNTHYEIAISIHDSVYSTDFSSTVISYFPDEPEKTAKSIQAHVLETLRKFSKEHLCKFLGAGVTLSLLREAPNLCTRLWLDMDIVPIVFNIKPYHTDSITRPNIKHRISSTTGSYVPSGAETPTVYIDSAQLTAAGLLPTGLSDRLPIPRTLDEQADSAARKCIMYFGPNNNPRLSIGPRNQVTVDAAGKIHLIDDLDEYKKTVGPGTWNAVVKLADELREKKVKIGFFSSTPQGGGVALMRHALIRFLTALDVDAAWYVPNPSPSVFRTTKNNHNILQGVAPPDLRLTKEAKENFDAWILKNGLRWTAEGGPLAPGGVDIAFIDDPQMPGLIPLIKRVRPGMPIVYRSHIEIRSDLVHVPGSPQEEVWKYLWNNIKLADLFISHPVSKFVPSDVPEAKLALLGAATDWLDGLNKHLDPWDAQFYMGEFRSLCAKEKMNELQWPQRDYVIQVARFDPAKGIPNVIDSYCKFRHLLTQPPVLTSDEYPQLLICGHGAVDDPDASIIYDQVMQLINSEKYAEYAQDIVVMRLPPSDQLLNALMANARIALQLSTREGFEVKVSEAVHAGIPVIASQTGGIPLQVEHGKSGYLTAPGDNAAVAQHLYELYTDEGLYRRISAYAKTHVSDEVGTVGNAAAWLYLAVMYHRGVKIRPQGAWLNDMLREETGEAYVEGEPRLPRGGLVVQGN

SEQ ID NO: 194 - protein, 735 aa, Trametes versicolor
  XP_008036133.1 trehalose synthase [Trametes versicolor FP-101664 SS1] EIW60750.1 trehalose synthase [Trametes versicolor FP-101664 SS1]
MAPSSPHHQFQSKTSDAIRRRLSSVVSSKRPNVQAYSSLTPMWAGIAGTVINNNTALELAISIHDSVYNTDFASSTVPYNPNNPEEQASNVEKHVLELLRKFATEHMCKFLGAGVTVSLLREAPNLCTRLWFDLDIVPIVFNIKPFHTDSVTRPNIKHRISSTTGSYVPSGAETPTVYYDPAQLPAGQANVTATQNKLPIPRTVDEQADSAARKCIMYFGPGNNPRLSIGARNQVTVDAGGKIHLIDDIDEYRKGNSKGTWNSVIKLADELREKKIKIGFFSSTPQGGGVALMRHALIRFLNLLDVDAAWYVPNPSPSVFRTTKNNHNILQGVADPNLRLSKEAKDNFDAWILKNGLRWTAEGGPLAPGGVDIAFIDDPQMPGLIPLIKRVRPDLPIIYRSHIEIRSDLVHVAGSPQEEVWKYLWNNIQHADLFISHPVNKFVPSDVPPEKLTLLGAATDWLDGLNKPLGDWDLQYYMGEFRQLCVKEKMNELGWPLRDYIVQIARFDPSKGIPNVIDSYARFRKLLAEKEPATEPPQMLICGHGAVDDPDASIIYDETMQLIHTKYAEYAKDFVVMRCPPSDQLLNALMENSKFALQLSTREGFEVKVSEALHAGKPVIASRTGGIPLQIEHGKSGYLCEPGDNAAVASHMFDLYTDDDLFDTMSEYARTHVSDEVGTVGNAAAWMYLAVMYCSRGVRLQPKGAWLNDLMRTECGEPYAPNEPRLPRAGLNVQG

SEQ ID NO: 195 - protein, 739 aa, Pleurotus pulmonarius
  A6YRN9.1 RecName: Full=Trehalose phosphorylase; AltName: Full=Trehalose synthase; Short=TSase; Flags: Precursor ABR88135.1 trehalose phosphorylase [Pleurotus pulmonarius]
MSTPHHQFESKSSTAIRRRLSSSVSSKQRPNIMTTTFASLTPMWAGVAGTLVNNNTQYEIAVTVHDGVYSTDFASVIIPVTPGDTVKNSKDIEAQVLNLIRKFSAEHLCKFLGAGITLALLKECPNLCTRLWLDMDIVPIVFNIKPFHTDSVTRPNIKHRISSTTGSYVPSGSETPTVYVEASHLDDPSHLSPNAAQKLPIPRTLDEQSDSAARKCLMYFGPNNNPRLSIGARNQVTVDAGGKIHLIDDLEEYRETVGAGTWNAVIKLADELREKKVKIGFFSSTPQGGGVALMRHALIRFLTALDVDVAWYVPNPSPQVFRTTKNNHNILQGVAAPDLRLTQEAKDAFDAWILKNGLRWTAEGGPLAPGGVDVVFIDDPQMPGLIPLIKKVRPEVPIVYRSHIEIRSDLVHVAGSPQEEVWKYLWNNIQLADLFISHPVSKFVPSDVPTEKLALLGAATDWLDGLNKDLDPWDSQFYMGEFRSPCAKEKMHELNWPARDYIVQVARFDPSKGIPNVVDSYYKFRNLLRTRSPDMDESEHPQLLICGHGAVDDPDASIIYDQIMALVNSDPYKEYAHDIVVMRLPPSDELLNAMMANSRIALQLSTREGFEVKVSEALHTGKPVIACRTGGIPLQIQHGKSGYLTTPGDNDAVAGHLYDLYTDEALYRKMSDFARTHVSDEVGTVGNAAAWLYLAVMYSRGEKIKPNGAWINDLLREETGEPYKEGETKLPRTKLDMQG

SEQ ID NO: 196 - protein, 737 aa, Agaricus bisporus
  XP_006458503.1 hypothetical protein AGABI2DRAFT_190782 [Agaricus bisporus var. bisporus H97] EKV50461.1 hypothetical protein AGABI2DRAFT_190782 [Agaricus bisporus var. bisporus H97]
MAHTAHPFSSVPSAAVRRRLSSSVSAKKPLVTATFSSLTPMWAGVAGVIINNNTEFEVAVSVHDSVYSTDFASVVLPYDPNDPEKNAKTIEQYILQVLRRFSVEHLCKFLGAGVTLTLLREVPNVCTRLWLDLDIVPFVFNIKQYHTDSLTRPNIKHRISSTTGSYVPSGAETPTVYVDSAHLKAMSGLQTGVSGRLPIQRTLDEQADSAARKCLMNFGPGNNPRLNIGPRNQVLVDDGGRVHLLDDLDEYRNTVGPRTWNAVIKLADELREKKVKIGFFSSTPQGGGVALMRHALIRFLTALDVDAAWYVPNPSPAVFRTTKNNHNILQGVAAPDLRLTEEARDAFDAWILKNGLRWTAEGGPLARGGVDVAFIDDPQMPGLIPLIKKIRPELPIVYRSHIEIRSDLVHVPGSPQEEVWKYLWKNIQLADLFISHPVSKFVPQDVPLEKVALLGAATDWLDGLNKDLDPWDSQYYMGEFRALCARERMLELRWPQRDYIIQVARFDPSKGIPNVIDSYVKFRELLKLKSPELDDEDHPQLLVCGHGAVDDPDASIIYDQIMQIINSEQYEAYAKDIVVMRLPPSDQLLNSLMSNAKIALQLSTREGFEVKVSEALHTGKPVIASRTGGIPLQIEHGKSGYLCTPGDNEAVAGHLYDLYTDEILYKTMSDYAKTHVSDEVGTVGNTAAWLYLAVMYNRGIKIKPNGAWLNDLLRTETGEDYEEGEPRLPRGGLKMQG

SEQ ID NO: 197 - protein, 737 aa, Agaricus bisporus
  XP_007326883.1 hypothetical protein AGABI1DRAFT_111552 [Agaricus bisporus var. burnettii JB137-S8] EKM83027.1 hypothetical protein AGABI1DRAFT_111552 [Agaricus bisporus var. burnettii JB137-S8]
MAHTAHPFYSVPSAAVRRRLSSSVSAKKPLVTATFSSLTPMWAGVAGVIINNNTEFEVAVSVHDSVYSTDFASVVLPYDPNDPEKNAKTIEQYILQVLRRFSVEHLCKFLGAGVTLTLLREVPNVCTRLWLDLDIVPFVFNIKQYHTDSLTRPNIKHRLSSATGSYVASGAETPTVYVDSAHLKAMSGLQTGVSGRLPIQRTLDEQADSAARKCLMNFGPGNNPRLNIGPRNQVLVDDGGRVHLLDDLDEYRNTVGPRTWNAVIKLADELREKKVKIGFFSSTPQGGGVALMRHALIRFLTALDVDAAWYVPNPSPAVFRTTKNNHNILQGVAAPDLRLTEEARDAFDAWILKNGLRWTAEGGPLARGGVDVAFIDDPQMPGLIPLIKKIRPELPIVYRSHIEIRSDLVHVPGSPQEEVWKYLWKNIQLADLFISHPVSKFVPQDVPLEKVALLGAATDWLDGLNKDLDPWDSQYYMGEFRALCARERMLELRWPQRDYIIQVARFDPSKGIPNVIDSYVKFRELLKLKSPELEDEDHPQLLVCGHGAVDDPDASIIYDQIMQIVNSEPYEAYAKDIVVMRLPPSDQLLNSLMSNAKIALQLSTREGFEVKVSEALHTGKPVIASRTGGIPLQIEHGKSGYLCTPGDNEAVAGHLYDLYTDEILYKTMSDYAKTHVSDEVGTVGNTAAWLYLAVMYNRGIKIKPNGAWLNDLLRTETGEDYEEGEPRLPRGGLKMQG

SEQ ID NO: 198 - protein, 733 aa, Laetiporus sulphureus
  KZT11205.1 glycosyltransferase family 4 protein [Laetiporus sulphureus 93-53]
MAPPHSFTSKPSVATRRRLSSVVTPNRPNVPGFTSLTPMWAGIAGTIINDNTAFEVAISIHDSVYCTDFASSVVPYDATDPEKQSVAIEKHVLDTLRKFSNEHLCKFLGAGVTLSLLREAPNLCTRLWLEMDIVPIVFNIKPYHTDSITRPNVKHRISSTTGSYVPSGAETPTVYVDASQLQDQSKLTTGAQQRLPIPRTVDEQADSAARKCIMYFGPGNNPRLSIAPRNQVAVDSGGKIHLIDDLDEYRKTVHKGTWNAVIKLADELREKKIRFAFFSSTPQGGGVALMRHALIRFFQALDVDAAWYVPNPSPSVFRTTKNNHNILQGVADPSLRLTQDQKENFDAWILKNGLRWTAEGGPLAKGGVDIAFIVDDPQMPGLIPLIKRVRPDMPIVYRSHIEIRSDLVSVAGSPQEEVWKYLWNNIQYADMFISHPVNKFVPTDVPLEKLALLGAATDWLDGLNKHLHPWDTQYYMGEFRQLCAREKMHELLWPVRDYVVQIARFDPSKGIPNVIDSYARFRRMMKSNAPNEDPPQLLVCGHGAVDDPDASIIYDQIIALVTGPYKEYEQDMIVMRCPPSDQLLNVLMANSRVALQLSTREGFEVKVSEALHAGKPVIASRTGGIPLQIEHGKSGFLCDAGDNEAVAKHMFDLITNEDLYEEMSEYARTHVSDEVGTVGNAAAWMYLAVMYCSRGVKLQPKGAWVNDMMREETGEPYEPGEPRLPRGHIHVQG

SEQ ID NO: 199 - protein, 736 aa, Gloeophyllum trabeum
  XP_007863746.1 trehalose synthase [Gloeophyllum trabeum ATCC 11539] EPQ58616.1 trehalose synthase [Gloeophyllum trabeum ATCC 11539]
MSPTQHFQSKPPDSYRRRLSSVISRRRPNVPQFSSLQAMWAGIAGGVVNNNTQFEIAISIHDSVYATDYASMQIPYSPNGDNGDKIEQQILSTLRKFSADHLCKFLGAGVTLSLLKEAPNLCTRLWLTLDIVPIVFNIKPYHTDSVTRPNIKHRLYSQTGSFAPSGADTPTVYVDPTPLAKNNVLAPGTAANLGTPTTKGLPIPRTMDEQADSAARKCIMYFGPGNNPRLSIGPRNQVLVDSAGKIHLIDDLDEYRKTVSSGTWNAVNKLADELREKKIKIGFFSSTPQGGGVALMRHALIRFLTLLDVDASWYVPNPSPSVFRTTKNNHNILQGVAAPSLRLTQDQKDNFDAWIQKNGLRWTAEGGPLAQGGVDIAFIDDPQMPGLIPLIKQVRPDMPIIYRSHIEIRSDLVHVKGSPQEEVWNYLWKNIQLADMFISHPVKKFVPSDVPTEKLAFLGAATDWLDGLNKPLDTWDSQYYMGEFRSLCVREKMHELKWPAREYVVQIARFDPSKGIPNVIDSYAKFRKMLAEKTELEEDIMPQLLICGHGAVDDPDASIIYDQVTGLIHSQYSQYSNDIIVMRLPPSDQLLNALMDNAKIALQLSTREGFEVKVSEALHTGKPVVASRTGGIPLQIEHGKSGYLVEVGDNETVAKHLFDLYTDEKLYDTMSEYARTHVSDEVGTVGNAAAWLYLAMMYCSRGEKVKPNGAWLNDLMREVTGEPYAPDEPKLPRVVN

SEQ ID NO: 200 - protein, 693 aa, Grifola frondosa
  OBZ75413.1 Trehalose phosphorylase [Grifola frondosa]
MAPPHQFQSKPSDVIRRRLSSAVSSKRPNIPGYTSLTPMWAGIAGAVVNNNTQFEVAISIHDSVYNTDFASSVVPYSPNEPEAQAGIIEKHVLETLRKFSTEHMCKFLGAGVTVILLREAPNLCTRLWLDMDIVPIVFNIKPFHTDSITRPNVRHRISSTTGSYVPSGAETPTVYYDPAQLQDPNKLSANVQTRLPIPRTVDEQADSAARKCIMYFGPGNNPRLQIGPRNQVAVDAGGKIHLIDDIDEYRKTVGKGTWNSVIKLADELREKKIKIGFFSSTPQGGGVALMRHAIIRFFTVLDVDAAWYVPNPSPSVFRTTKNNHNILQGVADPSLRLTKEAADNFDSWILKNGLRWTAEGGPLAPGGVDIAFIDDPQMPGLIPLIKRIRPDLPIIYRSHIEIRSDLVHVKGSPQEEVWNYLWNNIQHSDLFISHPVNKFVPSDVPLEKLALLGAATDWLDGLSKHLDAWDAQYYMGSSATYRSLRPVQGYPERDRLLLLCGHGAVDDPDASIIYDQVLQLIHAKYKEYAPDIVVMRCPPSDQLLNTLMANAKFALQLSTREGFEVKVSEALHAGKPVIACRTGGIPLQIEHGKSGYLCEPGDNAAVAQHMLDLYTDEDLYDTMSEYARTHVSDEVGTVGNAAAWMYLAVMYVSRGVKLRPHGAWINDLMRTEMGEPYRAGEPRLPRGELHVQG

SEQ ID NO: 201 - protein, 650 aa, Trametes pubescens
  OJT04097.1 Trehalose phosphorylase [Trametes pubescens]
MWAGIAGTVINNNTALELAISIHDSVYNTDFASSTVPYNPNNPEEQASNVEKHVLELLRKFATEHMCKFLGAGVTVSLLREAPNLCTRLWFDLDIVPIVFNIKPFHTDSVTRPNIKHRISSTTGSYVPSGAETPTVYYDPAQLPAGQANVAATQNKLPIPRTVDEQADSAARKCIMYFGPGNNPRLSIGARNQVTVDAGGKIHLIDDIDEYRKGNSKGTWNSVIKLADELREKKIKIGFFSSTPQGGVADPNLRLSKEAKDNFDAWILKNGLRWTAEGGPLAPGGVDIAFIDDPQMPGLIPLIKRVRPDLPIIYRSHIEIRSDLVHVAGSPQEEVWKYLWNNIQHADLFISHPVNKFVPSDVPPEKLTLLGAATDWLDGLNKPLGDWDLQYYMGEFRQLCVKEKMTELGWPLRDYIVQIARFDPSKGIPNVIDSYARFRKLLAEKEPGTEPPQMLICGHGAVDDPDASIIYDETMQLIHTKYAEYAKDFVVMRCPPSDQLLNALMENSKFALQLSTREGFEVKVSEALHAGKPVIASRTGGIPLQIEHGKSGYLCEPGDNAAVASHMFDLYTDDDLFDTMSEYARTHVSDEVGTVGNAAAWMYLAVMYVSRGVRLQPKGAWLNDLMRTECGEPYAPNEPRLPRAGLNVQG

SEQ ID NO: 202 - protein, 504 aa, Bifidobacterium magnum
  wild-type
MKNKVQMITYANRLGDGNLASLTEILRTRFNGAYEGVHILPFFTPFDGADAGFDPIDHTKVDPRLGDWNDIAELSKTHDIMVDAIVNHMSWESAQFQDVMKNGEESEYYPMFLTMSSVFPLGASEEDLAGIYRPRPGLPFTPYRFGNANRLVWTTFTPQQVDIDTDSDKGWEYLMSIFDQMSKSHVSQIRLDAVGYGAKEAGTSCFMTPKTFRLISRLREEGAKRCLEILIEVHSYYKKQIEIASKVDRVYDFALPPLLLHSLFTGDVDALSHWIDIRPNNAVTVLDTHDGIGVIDIGSDQQDRSLKGLVSDEAVDALVEKIAENSHGESKAATGAAASNLDLYQVNCTYYSALGCNDQQYLAARAVQFFLPGVPQVYYVGALAGRNDMTLLKETGVGRDINRHYYSVAEIDEDLKRPVVRALNDLAKFRNDCPAFDGEFTWERDGQDSVTLTWTNGDSHTSLTFQPNLGTQDAGAPVATLTWNDADGEHTSADLLTNPPVYRK

SEQ ID NO: 203 - protein, 504 aa, Bifidobacterium longum
  wild-type
MKNKVQLITYADRLGDGTLSSMTDILRTRFDGVYDGVHILPFFTPFDGADAGFDPIDHTKVDPRLGGWDDVAELSKTHGIMVDAIVNHMSWESKQFQDVLEKGEESEYYPMFLTMSSVFPNGATEEDLAGIYRPRPGLPFTHYKFAGKTRLVWVSFTPQQVDIDTDSDKGWEYLMSIFDQMAASHVSYIRLDAVGYGAKEAGTSCFMTPKTFKLISRLREEGVKRGLEILIEVHSYYKKQVEIASKVDRVYDFALPPLLLHSLNTGHVEPVAHWTDIRPNNAVTVLDTHDGIGVIDIGSDQLDRSLKGLVPDEDVDNLVNAIHANTHGESQAATGAAASNLDLYQVNSTYYSALGCNDQHYIAARAVQFFLPGVPQVYYVGALAGKNDMELLRKTNNGRDINRHYYSTAEIDENLQRPVVKALNALAKFRNELDAFDGTFSYSADGDTSISFTWEGTTTQATLTFEPGRGLGVENTASVATLEWRDAAGEHRTDDLIANPPVVA

SEQ ID NO: 204 - protein, 506 aa, Bifidobacterium animalis
  wild-type
MKNKVQLITYADRLGDGNLASMTDILRTRFDGVYEGVHILPFFTPFDGADAGFDPIDHTKVDARLGDWDDIAELAKTHDIMVDAIVNHMSWQSKQFQDVLANGEDSEYYPMFLTMSSVFPDGATEEELAGIYRPRPGLPFTHYSFAGKTRLVWVTFTPQQVDIDTDSAKGWEYLMSIFDQMSKSHVKYIRLDAVGYGAKEAGTSCFMTPKTFELISRLREEGAKRGLEILIEVHSYYKKQVEIAAKVDRVYDFALPPLLLHSLFTGKVDALAHWTEIRPNNAVTVLDTHDGIGVIDIGSDQLDRSLKGLVPDADVDNMVETIAKNTHGESKAATGAAASNLDLYQVNSTYYSALGCNDQHYIAARAVQFFLPGVPQVYYVGALAGENDMELLKRTNVGRDINRHYYTTSEIDKNLERPVVKALNALARFRNELPAFDGDFSYSVGDDESIAFSWNGFGSSATLTFTPSKGMGVENPQSVATLVWTDSTGEHRTDDLIANPPVMQAS

SEQ ID NO: 205 - protein, 503 aa, Bifidobacterium thermophilum
  wild-type
MKNKVQLITYANRLGEGTIKSLTDVLRTRFDGVYEGVHILPFFTPFDGADAGFDPVDHTKVDPRLGTWDDIAELSKTHDIMVDTIVNHMSWESKQFQDVMKRGEDSPYYPMFLTMSSVFPDGATEEDLAGIYRPRPGLPFTHYTWGGKTRLVWTTFTPQQVDIDTDSKEGWDYLLSILDQLSRSHVSYIRLDAVGYGAKQAKTSCFMTPKTFDLIGRIKAEAESRGLETLIEVHSYYKKQVAIANKVDRVYDFAIPGLLLHALTTGKTEPIAKWVEVRPNNAVTVLDTHDGIGVIDIGSDQLDRSLKGLVPDEEVDQLVETIHENTHGESRAATGAAASNLDLYQVNSTYYSALGCNDQHYLAARAVQFFLPGVPQVYYVGALAGANDMELLHRTNVGRDINRHYYSVEEIDRNLERPVVKALNALCRMRNQLDAFDGEFTFSHEGDTLTFDWKGETTSATLTFEPKRGLGVDNQASVCTLRWSDAAGEHETDDLLAAPPTVA

SEQ ID NO: 206 - protein, 504 aa, Bifidobacterium adolescentis [sequence omitted]

SEQ ID NO: 207 - protein, 504 aa, Artificial Sequence
  Description of Artificial Sequence: Synthetic polypeptide
  E92L
MKNKVQMITYANRLGDGNLASLTEILRTRFNGAYEGVHILPFFTPFDGADAGFDPIDHTKVDPRLGDWNDIAELSKTHDIMVDAIVNHMSWLSAQFQDVMKNGEESEYYPMFLTMSSVFPLGASEEDLAGIYRPRPGLPFTPYRFGNANRLVWTTFTPQQVDIDTDSDKGWEYLMSIFDQMSKSHVSQIRLDAVGYGAKEAGTSCFMTPKTFRLISRLREEGAKRCLEILIEVHSYYKKQIEIASKVDRVYDFALPPLLLHSLFTGDVDALSHWIDIRPNNAVTVLDTHDGIGVIDIGSDQQDRSLKGLVSDEAVDALVEKIAENSHGESKAATGAAASNLDLYQVNCTYYSALGCNDQQYLAARAVQFFLPGVPQVYYVGALAGRNDMTLLKETGVGRDINRHYYSVAEIDEDLKRPVVRALNDLAKFRNDCPAFDGEFTWERDGQDSVTLTWTNGDSHTSLTFQPNLGTQDAGAPVATLTWNDADGEHTSADLLTNPPVYRK

SEQ ID NO: 208 - protein, 504 aa, Artificial Sequence
  Description of Artificial Sequence: Synthetic polypeptide
  S124Q
MKNKVQMITYANRLGDGNLASLTEILRTRFNGAYEGVHILPFFTPFDGADAGFDPIDHTKVDPRLGDWNDIAELSKTHDIMVDAIVNHMSWESAQFQDVMKNGEESEYYPMFLTMSSVFPLGAQEEDLAGIYRPRPGLPFTPYRFGNANRLVWTTFTPQQVDIDTDSDKGWEYLMSIFDQMSKSHVSQIRLDAVGYGAKEAGTSCFMTPKTFRLISRLREEGAKRCLEILIEVHSYYKKQIEIASKVDRVYDFALPPLLLHSLFTGDVDALSHWIDIRPNNAVTVLDTHDGIGVIDIGSDQQDRSLKGLVSDEAVDALVEKIAENSHGESKAATGAAASNLDLYQVNCTYYSALGCNDQQYLAARAVQFFLPGVPQVYYVGALAGRNDMTLLKETGVGRDINRHYYSVAEIDEDLKRPVVRALNDLAKFRNDCPAFDGEFTWERDGQDSVTLTWTNGDSHTSLTFQPNLGTQDAGAPVATLTWNDADGEHTSADLLTNPPVYRK

SEQ ID NO: 209 - protein, 504 aa, Artificial Sequence
  Description of Artificial Sequence: Synthetic polypeptide
  S124K
MKNKVQMITYANRLGDGNLASLTEILRTRFNGAYEGVHILPFFTPFDGADAGFDPIDHTKVDPRLGDWNDIAELSKTHDIMVDAIVNHMSWESAQFQDVMKNGEESEYYPMFLTMSSVFPLGAKEEDLAGIYRPRPGLPFTPYRFGNANRLVWTTFTPQQVDIDTDSDKGWEYLMSIFDQMSKSHVSQIRLDAVGYGAKEAGTSCFMTPKTFRLISRLREEGAKRCLEILIEVHSYYKKQIEIASKVDRVYDFALPPLLLHSLFTGDVDALSHWIDIRPNNAVTVLDTHDGIGVIDIGSDQQDRSLKGLVSDEAVDALVEKIAENSHGESKAATGAAASNLDLYQVNCTYYSALGCNDQQYLAARAVQFFLPGVPQVYYVGALAGRNDMTLLKETGVGRDINRHYYSVAEIDEDLKRPVVRALNDLAKFRNDCPAFDGEFTWERDGQDSVTLTWTNGDSHTSLTFQPNLGTQDAGAPVATLTWNDADGEHTSADLLTNPPVYRK

SEQ ID NO: 210 - protein, 504 aa, Artificial Sequence
  Description of Artificial Sequence: Synthetic polypeptide
  S124T
MKNKVQMITYANRLGDGNLASLTEILRTRFNGAYEGVHILPFFTPFDGADAGFDPIDHTKVDPRLGDWNDIAELSKTHDIMVDAIVNHMSWESAQFQDVMKNGEESEYYPMFLTMSSVFPLGATEEDLAGIYRPRPGLPFTPYRFGNANRLVWTTFTPQQVDIDTDSDKGWEYLMSIFDQMSKSHVSQIRLDAVGYGAKEAGTSCFMTPKTFRLISRLREEGAKRCLEILIEVHSYYKKQIEIASKVDRVYDFALPPLLLHSLFTGDVDALSHWIDIRPNNAVTVLDTHDGIGVIDIGSDQQDRSLKGLVSDEAVDALVEKIAENSHGESKAATGAAASNLDLYQVNCTYYSALGCNDQQYLAARAVQFFLPGVPQVYYVGALAGRNDMTLLKETGVGRDINRHYYSVAEIDEDLKRPVVRALNDLAKFRNDCPAFDGEFTWERDGQDSVTLTWTNGDSHTSLTFQPNLGTQDAGAPVATLTWNDADGEHTSADLLTNPPVYRK

SEQ ID NO: 211 - protein, 504 aa, Artificial Sequence
  Description of Artificial Sequence: Synthetic polypeptide
  A148R
MKNKVQMITYANRLGDGNLASLTEILRTRFNGAYEGVHILPFFTPFDGADAGFDPIDHTKVDPRLGDWNDIAELSKTHDIMVDAIVNHMSWESAQFQDVMKNGEESEYYPMFLTMSSVFPLGASEEDLAGIYRPRPGLPFTPYRFGNRNRLVWTTFTPQQVDIDTDSDKGWEYLMSIFDQMSKSHVSQIRLDAVGYGAKEAGTSCFMTPKTFRLISRLREEGAKRCLEILIEVHSYYKKQIEIASKVDRVYDFALPPLLLHSLFTGDVDALSHWIDIRPNNAVTVLDTHDGIGVIDIGSDQQDRSLKGLVSDEAVDALVEKIAENSHGESKAATGAAASNLDLYQVNCTYYSALGCNDQQYLAARAVQFFLPGVPQVYYVGALAGRNDMTLLKETGVGRDINRHYYSVAEIDEDLKRPVVRALNDLAKFRNDCPAFDGEFTWERDGQDSVTLTWTNGDSHTSLTFQPNLGTQDAGAPVATLTWNDADGEHTSADLLTNPPVYRK

SEQ ID NO: 212 - protein, 504 aa, Artificial Sequence
  Description of Artificial Sequence: Synthetic polypeptide
  A148K
MKNKVQMITYANRLGDGNLASLTEILRTRFNGAYEGVHILPFFTPFDGADAGFDPIDHTKVDPRLGDWNDIAELSKTHDIMVDAIVNHMSWESAQFQDVMKNGEESEYYPMFLTMSSVFPLGASEEDLAGIYRPRPGLPFTPYRFGNKNRLVWTTFTPQQVDIDTDSDKGWEYLMSIFDQMSKSHVSQIRLDAVGYGAKEAGTSCFMTPKTFRLISRLREEGAKRCLEILIEVHSYYKKQIEIASKVDRVYDFALPPLLLHSLFTGDVDALSHWIDIRPNNAVTVLDTHDGIGVIDIGSDQQDRSLKGLVSDEAVDALVEKIAENSHGESKAATGAAASNLDLYQVNCTYYSALGCNDQQYLAARAVQFFLPGVPQVYYVGALAGRNDMTLLKETGVGRDINRHYYSVAEIDEDLKRPVVRALNDLAKFRNDCPAFDGEFTWERDGQDSVTLTWTNGDSHTSLTFQPNLGTQDAGAPVATLTWNDADGEHTSADLLTNPPVYRK

SEQ ID NO: 213 - protein, 504 aa, Artificial Sequence
  Description of Artificial Sequence: Synthetic polypeptide
  T157D
MKNKVQMITYANRLGDGNLASLTEILRTRFNGAYEGVHILPFFTPFDGADAGFDPIDHTKVDPRLGDWNDIAELSKTHDIMVDAIVNHMSWESAQFQDVMKNGEESEYYPMFLTMSSVFPLGASEEDLAGIYRPRPGLPFTPYRFGNANRLVWTTFDPQQVDIDTDSDKGWEYLMSIFDQMSKSHVSQIRLDAVGYGAKEAGTSCFMTPKTFRLISRLREEGAKRCLEILIEVHSYYKKQIEIASKVDRVYDFALPPLLLHSLFTGDVDALSHWIDIRPNNAVTVLDTHDGIGVIDIGSDQQDRSLKGLVSDEAVDALVEKIAENSHGESKAATGAAASNLDLYQVNCTYYSALGCNDQQYLAARAVQFFLPGVPQVYYVGALAGRNDMTLLKETGVGRDINRHYYSVAEIDEDLKRPVVRALNDLAKFRNDCPAFDGEFTWERDGQDSVTLTWTNGDSHTSLTFQPNLGTQDAGAPVATLTWNDADGEHTSADLLTNPPVYRK

SEQ ID NO: 214 - protein, 504 aa, Artificial Sequence
  Description of Artificial Sequence: Synthetic polypeptide
  Q188Y
MKNKVQMITYANRLGDGNLASLTEILRTRFNGAYEGVHILPFFTPFDGADAGFDPIDHTKVDPRLGDWNDIAELSKTHDIMVDAIVNHMSWESAQFQDVMKNGEESEYYPMFLTMSSVFPLGASEEDLAGIYRPRPGLPFTPYRFGNANRLVWTTFTPQQVDIDTDSDKGWEYLMSIFDQMSKSHVSYIRLDAVGYGAKEAGTSCFMTPKTFRLISRLREEGAKRCLEILIEVHSYYKKQIEIASKVDRVYDFALPPLLLHSLFTGDVDALSHWIDIRPNNAVTVLDTHDGIGVIDIGSDQQDRSLKGLVSDEAVDALVEKIAENSHGESKAATGAAASNLDLYQVNCTYYSALGCNDQQYLAARAVQFFLPGVPQVYYVGALAGRNDMTLLKETGVGRDINRHYYSVAEIDEDLKRPVVRALNDLAKFRNDCPAFDGEFTWERDGQDSVTLTWTNGDSHTSLTFQPNLGTQDAGAPVATLTWNDADGEHTSADLLTNPPVYRK

SEQ ID NO: 215 - protein, 504 aa, Artificial Sequence
  Description of Artificial Sequence: Synthetic polypeptide
  I231V
MKNKVQMITYANRLGDGNLASLTEILRTRFNGAYEGVHILPFFTPFDGADAGFDPIDHTKVDPRLGDWNDIAELSKTHDIMVDAIVNHMSWESAQFQDVMKNGEESEYYPMFLTMSSVFPLGASEEDLAGIYRPRPGLPFTPYRFGNANRLVWTTFTPQQVDIDTDSDKGWEYLMSIFDQMSKSHVSQIRLDAVGYGAKEAGTSCFMTPKTFRLISRLREEGAKRCLEILVEVHSYYKKQIEIASKVDRVYDFALPPLLLHSLFTGDVDALSHWIDIRPNNAVTVLDTHDGIGVIDIGSDQQDRSLKGLVSDEAVDALVEKIAENSHGESKAATGAAASNLDLYQVNCTYYSALGCNDQQYLAARAVQFFLPGVPQVYYVGALAGRNDMTLLKETGVGRDINRHYYSVAEIDEDLKRPVVRALNDLAKFRNDCPAFDGEFTWERDGQDSVTLTWTNGDSHTSLTFQPNLGTQDAGAPVATLTWNDADGEHTSADLLTNPPVYRK

SEQ ID NO: 216 - protein, 504 aa, Artificial Sequence
  Description of Artificial Sequence: Synthetic polypeptide
  L371A
MKNKVQMITYANRLGDGNLASLTEILRTRFNGAYEGVHILPFFTPFDGADAGFDPIDHTKVDPRLGDWNDIAELSKTHDIMVDAIVNHMSWESAQFQDVMKNGEESEYYPMFLTMSSVFPLGASEEDLAGIYRPRPGLPFTPYRFGNANRLVWTTFTPQQVDIDTDSDKGWEYLMSIFDQMSKSHVSQIRLDAVGYGAKEAGTSCFMTPKTFRLISRLREEGAKRCLEILIEVHSYYKKQIEIASKVDRVYDFALPPLLLHSLFTGDVDALSHWIDIRPNNAVTVLDTHDGIGVIDIGSDQQDRSLKGLVSDEAVDALVEKIAENSHGESKAATGAAASNLDLYQVNCTYYSALGCNDQQYLAARAVQFFAPGVPQVYYVGALAGRNDMTLLKETGVGRDINRHYYSVAEIDEDLKRPVVRALNDLAKFRNDCPAFDGEFTWERDGQDSVTLTWTNGDSHTSLTFQPNLGTQDAGAPVATLTWNDADGEHTSADLLTNPPVYRK

SEQ ID NO: 217 - protein, 504 aa, Artificial Sequence
  Description of Artificial Sequence: Synthetic polypeptide
  T461G
MKNKVQMITYANRLGDGNLASLTEILRTRFNGAYEGVHILPFFTPFDGADAGFDPIDHTKVDPRLGDWNDIAELSKTHDIMVDAIVNHMSWESAQFQDVMKNGEESEYYPMFLTMSSVFPLGASEEDLAGIYRPRPGLPFTPYRFGNANRLVWTTFTPQQVDIDTDSDKGWEYLMSIFDQMSKSHVSQIRLDAVGYGAKEAGTSCFMTPKTFRLISRLREEGAKRCLEILIEVHSYYKKQIEIASKVDRVYDFALPPLLLHSLFTGDVDALSHWIDIRPNNAVTVLDTHDGIGVIDIGSDQQDRSLKGLVSDEAVDALVEKIAENSHGESKAATGAAASNLDLYQVNCTYYSALGCNDQQYLAARAVQFFLPGVPQVYYVGALAGRNDMTLLKETGVGRDINRHYYSVAEIDEDLKRPVVRALNDLAKFRNDCPAFDGEFTWERDGQDSVTLTWTNGDSHGSLTFQPNLGTQDAGAPVATLTWNDADGEHTSADLLTNPPVYRK

SEQ ID NO: 218 - protein, 504 aa, Artificial Sequence
  Description of Artificial Sequence: Synthetic polypeptide
  A148K_Q188Y
MKNKVQMITYANRLGDGNLASLTEILRTRFNGAYEGVHILPFFTPFDGADAGFDPIDHTKVDPRLGDWNDIAELSKTHDIMVDAIVNHMSWESAQFQDVMKNGEESEYYPMFLTMSSVFPLGASEEDLAGIYRPRPGLPFTPYRFGNKNRLVWTTFTPQQVDIDTDSDKGWEYLMSIFDQMSKSHVSYIRLDAVGYGAKEAGTSCFMTPKTFRLISRLREEGAKRCLEILIEVHSYYKKQIEIASKVDRVYDFALPPLLLHSLFTGDVDALSHWIDIRPNNAVTVLDTHDGIGVIDIGSDQQDRSLKGLVSDEAVDALVEKIAENSHGESKAATGAAASNLDLYQVNCTYYSALGCNDQQYLAARAVQFFLPGVPQVYYVGALAGRNDMTLLKETGVGRDINRHYYSVAEIDEDLKRPVVRALNDLAKFRNDCPAFDGEFTWERDGQDSVTLTWTNGDSHTSLTFQPNLGTQDAGAPVATLTWNDADGEHTSADLLTNPPVYRK

SEQ ID NO: 219 - protein, 504 aa, Artificial Sequence
  Description of Artificial Sequence: Synthetic polypeptide
  A148K_T157D_Q188Y_L371A_T461G
MKNKVQMITYANRLGDGNLASLTEILRTRFNGAYEGVHILPFFTPFDGADAGFDPIDHTKVDPRLGDWNDIAELSKTHDIMVDAIVNHMSWESAQFQDVMKNGEESEYYPMFLTMSSVFPLGASEEDLAGIYRPRPGLPFTPYRFGNKNRLVWTTFDPQQVDIDTDSDKGWEYLMSIFDQMSKSHVSYIRLDAVGYGAKEAGTSCFMTPKTFRLISRLREEGAKRCLEILIEVHSYYKKQIEIASKVDRVYDFALPPLLLHSLFTGDVDALSHWIDIRPNNAVTVLDTHDGIGVIDIGSDQQDRSLKGLVSDEAVDALVEKIAENSHGESKAATGAAASNLDLYQVNCTYYSALGCNDQQYLAARAVQFFAPGVPQVYYVGALAGRNDMTLLKETGVGRDINRHYYSVAEIDEDLKRPVVRALNDLAKFRNDCPAFDGEFTWERDGQDSVTLTWTNGDSHGSLTFQPNLGTQDAGAPVATLTWNDADGEHTSADLLTNPPVYRK

SEQ ID NO: 220 - protein, 388 aa, Streptomyces sp. SK
MNYQPTPEDRFTFGLWTVGWQGRDPFGDATRPALDPVEAVQRLAELGAYGVTFHDDDLIPFGASDTEREAHVKRFRQALDATGMTVPMATTNLFTHPVFKDGAFTANDRDVRRYALRKTIRNIDLAVELGAKVYVAWGGREGAESGAAKDVRAALDRMKEAFDLLGEYVTSQGYDIRFAIEPKPNEPRGDILLPTIGHALAFIERLERPELYGVNPEVGHEQMAGLNFPHGIAQALWAGKLFHIDLNGQSGIKYDQDLRFGAGDLRAAFWLVDLLESAGWEGPRHFDFKPPRTEDIDGVWASAAGCMRNYLILKERAAAFRADPEVQEALRAARLDQLAEPTAADGLQALLADRTAYEDFDVDAAAARGMAFERLDQLAMDHLLGARG

SEQ ID NO: 221 - protein, 388 aa, Artificial Sequence
  Description of Artificial Sequence: Synthetic polypeptide
  variant of SEQ ID 220
MNYQPTPEDRFTFGLWTVGWQGRDPFGDATRPILDPVEAVQRLAELGAYGVTFHDDDLIPFGASDTEREAHVKRFRQALDATGMTVPMATTNLFTHPVFKDGAFTANDRDVRRYALRKTIRNIDLAVELGAKVYVAWGGREGAESGAAKDVRAALDRMKEAFDLLGEYVTSQGYDIRFAIEPKPNEPRGDILLPTIGHALAFIERLERPELYGVNPEVGHEQMAGLNFPHGIAQALWAGKLFHIDLNGQSGIKYDQDLRFGAGDLRAAFWLVDLLESAGWEGPRHFDFKPPRTEDIDGVWASAAGCMRNYLILKERAAAFRADPEVQEALRAARLDQLAEPTAADGLQALLADRTAYEDFDVDAAAARGMAFERLDQLAMDHLLGARG

SEQ ID NO: 222 - protein, 388 aa, Artificial Sequence
  Description of Artificial Sequence: Synthetic polypeptide
  variant of SEQ ID 220
MNYQPTPEDRFTFGLWTVGWQGRDPFGDATRPNLDPVEAVQRLAELGAYGVTFHDDDLIPFGASDTEREAHVKRFRQALDATGMTVPMATTNLFTHPVFKDGAFTANDRDVRRYALRKTIRNIDLAVELGAKVYVAWGGREGAESGAAKDVRAALDRMKEAFDLLGEYVTSQGYDIRFAIEPKPNEPRGDILLPTIGHALAFIERLERPELYGVNPEVGHEQMAGLNFPHGIAQALWAGKLFHIDLNGQSGIKYDQDLRFGAGDLRAAFWLVDLLESAGWEGPRHFDFKPPRTEDIDGVWASAAGCMRNYLILKERAAAFRADPEVQEALRAARLDQLAEPTAADGLQALLADRTAYEDFDVDAAAARGMAFERLDQLAMDHLLGARG

SEQ ID NO: 223 - protein, 388 aa, Artificial Sequence
  Description of Artificial Sequence: Synthetic polypeptide
  variant of SEQ ID 220
MNYQPTPEDRFTFGLWTVGWQGRDPFGDATRPAFDPVEAVQRLAELGAYGVTFHDDDLIPFGASDTEREAHVKRFRQALDATGMTVPMATTNLFTHPVFKDGAFTANDRDVRRYALRKTIRNIDLAVELGAKVYVAWGGREGAESGAAKDVRAALDRMKEAFDLLGEYVTSQGYDIRFAIEPKPNEPRGDILLPTIGHALAFIERLERPELYGVNPEVGHEQMAGLNFPHGIAQALWAGKLFHIDLNGQSGIKYDQDLRFGAGDLRAAFWLVDLLESAGWEGPRHFDFKPPRTEDIDGVWASAAGCMRNYLILKERAAAFRADPEVQEALRAARLDQLAEPTAADGLQALLADRTAYEDFDVDAAAARGMAFERLDQLAMDHLLGARG

SEQ ID NO: 224 - protein, 388 aa, Artificial Sequence
  Description of Artificial Sequence: Synthetic polypeptide
  variant of SEQ ID 220
MNYQPTPEDRFTFGLWTVGWQGRDPFGDATRPALCPVEAVQRLAELGAYGVTFHDDDLIPFGASDTEREAHVKRFRQALDATGMTVPMATTNLFTHPVFKDGAFTANDRDVRRYALRKTIRNIDLAVELGAKVYVAWGGREGAESGAAKDVRAALDRMKEAFDLLGEYVTSQGYDIRFAIEPKPNEPRGDILLPTIGHALAFIERLERPELYGVNPEVGHEQMAGLNFPHGIAQALWAGKLFHIDLNGQSGIKYDQDLRFGAGDLRAAFWLVDLLESAGWEGPRHFDFKPPRTEDIDGVWASAAGCMRNYLILKERAAAFRADPEVQEALRAARLDQLAEPTAADGLQALLADRTAYEDFDVDAAAARGMAFERLDQLAMDHLLGARG

SEQ ID NO: 225 - protein, 388 aa, Artificial Sequence
  Description of Artificial Sequence: Synthetic polypeptide
  variant of SEQ ID 220
MNYQPTPEDRFTFGLWTVGWQGRDPFGDATRPALDPVEAVQRLAELGAYGVTLHDDDLIPFGASDTEREAHVKRFRQALDATGMTVPMATTNLFTHPVFKDGAFTANDRDVRRYALRKTIRNIDLAVELGAKVYVAWGGREGAESGAAKDVRAALDRMKEAFDLLGEYVTSQGYDIRFAIEPKPNEPRGDILLPTIGHALAFIERLERPELYGVNPEVGHEQMAGLNFPHGIAQALWAGKLFHIDLNGQSGIKYDQDLRFGAGDLRAAFWLVDLLESAGWEGPRHFDFKPPRTEDIDGVWASAAGCMRNYLILKERAAAFRADPEVQEALRAARLDQLAEPTAADGLQALLADRTAYEDFDVDAAAARGMAFERLDQLAMDHLLGARG

SEQ ID NO: 226 - protein, 388 aa, Artificial Sequence
  Description of Artificial Sequence: Synthetic polypeptide
  variant of SEQ ID 220
MNYQPTPEDRFTFGLWTVGWQGRDPFGDATRPALDPVEAVQRLAELGAYGVTFHDDDLIPFGASDTEREAHVKRFRQALDATGMTVPMVTTNLFTHPVFKDGAFTANDRDVRRYALRKTIRNIDLAVELGAKVYVAWGGREGAESGAAKDVRAALDRMKEAFDLLGEYVTSQGYDIRFAIEPKPNEPRGDILLPTIGHALAFIERLERPELYGVNPEVGHEQMAGLNFPHGIAQALWAGKLFHIDLNGQSGIKYDQDLRFGAGDLRAAFWLVDLLESAGWEGPRHFDFKPPRTEDIDGVWASAAGCMRNYLILKERAAAFRADPEVQEALRAARLDQLAEPTAADGLQALLADRTAYEDFDVDAAAARGMAFERLDQLAMDHLLGARG

SEQ ID NO: 227 - protein, 388 aa, Artificial Sequence
  Description of Artificial Sequence: Synthetic polypeptide
  variant of SEQ ID 220
MNYQPTPEDRFTFGLWTVGWQGRDPFGDATRPALDPVEAVQRLAELGAYGVTFHDDDLIPFGASDTEREAHVKRFRQALDATGMTVPMASTNLFTHPVFKDGAFTANDRDVRRYALRKTIRNIDLAVELGAKVYVAWGGREGAESGAAKDVRAALDRMKEAFDLLGEYVTSQGYDIRFAIEPKPNEPRGDILLPTIGHALAFIERLERPELYGVNPEVGHEQMAGLNFPHGIAQALWAGKLFHIDLNGQSGIKYDQDLRFGAGDLRAAFWLVDLLESAGWEGPRHFDFKPPRTEDIDGVWASAAGCMRNYLILKERAAAFRADPEVQEALRAARLDQLAEPTAADGLQALLADRTAYEDFDVDAAAARGMAFERLDQLAMDHLLGARG

SEQ ID NO: 228 - protein, 388 aa, Artificial Sequence
  Description of Artificial Sequence: Synthetic polypeptide
  variant of SEQ ID 220
MNYQPTPEDRFTFGLWTVGWQGRDPFGDATRPALDPVEAVQRLAELGAYGVTFHDDDLIPFGASDTEREAHVKRFRQALDATGMTVPMATTNLFRHPVFKDGAFTANDRDVRRYALRKTIRNIDLAVELGAKVYVAWGGREGAESGAAKDVRAALDRMKEAFDLLGEYVTSQGYDIRFAIEPKPNEPRGDILLPTIGHALAFIERLERPELYGVNPEVGHEQMAGLNFPHGIAQALWAGKLFHIDLNGQSGIKYDQDLRFGAGDLRAAFWLVDLLESAGWEGPRHFDFKPPRTEDIDGVWASAAGCMRNYLILKERAAAFRADPEVQEALRAARLDQLAEPTAADGLQALLADRTAYEDFDVDAAAARGMAFERLDQLAMDHLLGARG

SEQ ID NO: 229 - protein, 388 aa, Artificial Sequence
  Description of Artificial Sequence: Synthetic polypeptide
  variant of SEQ ID 220
MNYQPTPEDRFTFGLWTVGWQGRDPFGDATRPALDPVEAVQRLAELGAYGVTFHDDDLIPFGASDTEREAHVKRFRQALDATGMTVPMATTNLFYHPVFKDGAFTANDRDVRRYALRKTIRNIDLAVELGAKVYVAWGGREGAESGAAKDVRAALDRMKEAFDLLGEYVTSQGYDIRFAIEPKPNEPRGDILLPTIGHALAFIERLERPELYGVNPEVGHEQMAGLNFPHGIAQALWAGKLFHIDLNGQSGIKYDQDLRFGAGDLRAAFWLVDLLESAGWEGPRHFDFKPPRTEDIDGVWASAAGCMRNYLILKERAAAFRADPEVQEALRAARLDQLAEPTAADGLQALLADRTAYEDFDVDAAAARGMAFERLDQLAMDHLLGARG

SEQ ID NO: 230 - protein, 388 aa, Artificial Sequence
  Description of Artificial Sequence: Synthetic polypeptide
  variant of SEQ ID 220
MNYQPTPEDKFTFGLWTVGWQGRDPFGDATRPALDPVEAVQRLAELGAYGVTFHDDDLIPFGASDTEREAHVKRFRQALDATGMTVPMATTNLFTHPVFKDGAFTANDRDVRRYALRKTIRNIDLAVELGAKVYVAWGGREGAESGAAKDVRAALDRMKEAFDLLGEYVTSQGYDIRFAIEPKPNEPRGDILLPTIGHALAFIERLERPELYGVNPEVGHEQMAGLNFPHGIAQALWAGKLFHIDLNGQSGIKYDQDLRFGAGDLRAAFWLVDLLESAGWEGPRHFDFKPPRTEDIDGVWASAAGCMRNYLILKERAAAFRADPEVQEALRAARLDQLAEPTAADGLQALLADRTAYEDFDVDAAAARGMAFERLDQLAMDHLLGARG

SEQ ID NO: 231 - protein, 388 aa, Artificial Sequence
  Description of Artificial Sequence: Synthetic polypeptide
  variant of SEQ ID 220
MNYQPTPEDRFTFGLWTVGWQGRDPFGDATRPALDPVEAVQRLAELGAYGVTFHDDDLFPFGASDTEREAHVKRFRQALDATGMTVPMATTNLFTHPVFKDGAFTANDRDVRRYALRKTIRNIDLAVELGAKVYVAWGGREGAESGAAKDVRAALDRMKEAFDLLGEYVTSQGYDIRFAIEPKPNEPRGDILLPTIGHALAFIERLERPELYGVNPEVGHEQMAGLNFPHGIAQALWAGKLFHIDLNGQSGIKYDQDLRFGAGDLRAAFWLVDLLESAGWEGPRHFDFKPPRTEDIDGVWASAAGCMRNYLILKERAAAFRADPEVQEALRAARLDQLAEPTAADGLQALLADRTAYEDFDVDAAAARGMAFERLDQLAMDHLLGARG

SEQ ID NO: 232 - protein, 388 aa, Artificial Sequence
  Description of Artificial Sequence: Synthetic polypeptide
  variant of SEQ ID 220
MNYQPTPEDKFTFGLWTVGWQGRDPFGDATRPALDPVEAVQRLAELGAYGVTLHDDDLIPFGASDTEREAHVKRFRQALDATGMTVPMATTNLFYHPVFKDGAFTANDRDVRRYALRKTIRNIDLAVELGAKVYVAWGGREGAESGAAKDVRAALDRMKEAFDLLGEYVTSQGYDIRFAIEPKPNEPRGDILLPTIGHALAFIERLERPELYGVNPEVGHEQMAGLNFPHGIAQALWAGKLFHIDLNGQSGIKYDQDLRFGAGDLRAAFWLVDLLESAGWEGPRHFDFKPPRTEDIDGVWASAAGCMRNYLILKERAAAFRADPEVQEALRAARLDQLAEPTAADGLQALLADRTAYEDFDVDAAAARGMAFERLDQLAMDHLLGARG

SEQ ID NO: 233 - protein, 388 aa, Artificial Sequence
  Description of Artificial Sequence: Synthetic polypeptide
  variant of SEQ ID 220
MNYQPTPEDKFTFGLWTVGWQGRDPFGDATRPALDPVEAVQRLAELGAYGVTLHDDDLIPFGASDTEREAHVKRFRQALDATGMTVPMASTNLFYHPVFKDGAFTANDRDVRRYALRKTIRNIDLAVELGAKVYVAWGGREGAESGAAKDVRAALDRMKEAFDLLGEYVTSQGYDIRFAIEPKPNEPRGDILLPTIGHALAFIERLERPELYGVNPEVGHEQMAGLNFPHGIAQALWAGKLFHIDLNGQSGIKYDQDLRFGAGDLRAAFWLVDLLESAGWEGPRHFDFKPPRTEDIDGVWASAAGCMRNYLILKERAAAFRADPEVQEALRAARLDQLAEPTAADGLQALLADRTAYEDFDVDAAAARGMAFERLDQLAMDHLLGARG

SEQ ID NO: 234 - protein, 388 aa, Artificial Sequence
  Description of Artificial Sequence: Synthetic polypeptide
  variant of SEQ ID 220
MNYQPTPEDKFTFGLWTVGWQGRDPFGDATRPNLDPVEAVQRLAELGAYGVTLHDDDLIPFGASDTEREAHVKRFRQALDATGMTVPMASTNLFYHPVFKDGAFTANDRDVRRYALRKTIRNIDLAVELGAKVYVAWGGREGAESGAAKDVRAALDRMKEAFDLLGEYVTSQGYDIRFAIEPKPNEPRGDILLPTIGHALAFIERLERPELYGVNPEVGHEQMAGLNFPHGIAQALWAGKLFHIDLNGQSGIKYDQDLRFGAGDLRAAFWLVDLLESAGWEGPRHFDFKPPRTEDIDGVWASAAGCMRNYLILKERAAAFRADPEVQEALRAARLDQLAEPTAADGLQALLADRTAYEDFDVDAAAARGMAFERLDQLAMDHLLGARG

SEQ ID NO: 235 - protein, 388 aa, Artificial Sequence
  Description of Artificial Sequence: Synthetic polypeptide
  variant of SEQ ID 220
MNYQPTPEDKFTFGLWTVGWQGRDPFGDATRPALDPVEAVQRLAELGAYGVTLHDDDLIPFGASDTEREAHVKRFRQALDATGMTVPMASTNLFTHPVFKDGAFTANDRDVRRYALRKTIRNIDLAVELGAKVYVAWGGREGAESGAAKDVRAALDRMKEAFDLLGEYVTSQGYDIRFAIEPKPNEPRGDILLPTIGHALAFIERLERPELYGVNPEVGHEQMAGLNFPHGIAQALWAGKLFHIDLNGQSGIKYDQDLRFGAGDLRAAFWLVDLLESAGWEGPRHFDFKPPRTEDIDGVWASAAGCMRNYLILKERAAAFRADPEVQEALRAARLDQLAEPTAADGLQALLADRTAYEDFDVDAAAARGMAFERLDQLAMDHLLGARG

SEQ ID NO: 236 - protein, 388 aa, Artificial Sequence
  Description of Artificial Sequence: Synthetic polypeptide
  variant of SEQ ID 220
MNYQPTPEDKFTFGLWTVGWQGRDPFGDATRPALDPVEAVQRLAELGAYGVTFHDDDLIPFGASDTEREAHVKRFRQALDATGMTVPMVSTNLFYHPVFKDGAFTANDRDVRRYALRKTIRNIDLAVELGAKVYVAWGGREGAESGAAKDVRAALDRMKEAFDLLGEYVTSQGYDIRFAIEPKPNEPRGDILLPTIGHALAFIERLERPELYGVNPEVGHEQMAGLNFPHGIAQALWAGKLFHIDLNGQSGIKYDQDLRFGAGDLRAAFWLVDLLESAGWEGPRHFDFKPPRTEDIDGVWASAAGCMRNYLILKERAAAFRADPEVQEALRAARLDQLAEPTAADGLQALLADRTAYEDFDVDAAAARGMAFERLDQLAMDHLLGARG

SEQ ID NO: 237 - protein, 388 aa, Artificial Sequence
  Description of Artificial Sequence: Synthetic polypeptide
  variant of SEQ ID 220
MNYQPTPEDKFTFGLWTVGWQGRDPFGDATRPILDPVEAVQRLAELGAYGVTLHDDDLIPFGASDTEREAHVKRFRQALDATGMTVPMASTNLFYHPVFKDGAFTANDRDVRRYALRKTIRNIDLAVELGAKVYVAWGGREGAESGAAKDVRAALDRMKEAFDLLGEYVTSQGYDIRFAIEPKPNEPRGDILLPTIGHALAFIERLERPELYGVNPEVGHEQMAGLNFPHGIAQALWAGKLFHIDLNGQSGIKYDQDLRFGAGDLRAAFWLVDLLESAGWEGPRHFDFKPPRTEDIDGVWASAAGCMRNYLILKERAAAFRADPEVQEALRAARLDQLAEPTAADGLQALLADRTAYEDFDVDAAAARGMAFERLDQLAMDHLLGARG

SEQ ID NO: 238 - protein, 388 aa, Artificial Sequence
  Description of Artificial Sequence: Synthetic polypeptide
  variant of SEQ ID 220
MNYQPTPEDKFTFGLWTVGWQGRDPFGDATRPALSPVEAVQRLAELGAYGVTLHDDDLIPFGASDTEREAHVKRFRQALDATGMTVPMASTNLFYHPVFKDGAFTANDRDVRRYALRKTIRNIDLAVELGAKVYVAWGGREGAESGAAKDVRAALDRMKEAFDLLGEYVTSQGYDIRFAIEPKPNEPRGDILLPTIGHALAFIERLERPELYGVNPEVGHEQMAGLNFPHGIAQALWAGKLFHIDLNGQSGIKYDQDLRFGAGDLRAAFWLVDLLESAGWEGPRHFDFKPPRTEDIDGVWASAAGCMRNYLILKERAAAFRADPEVQEALRAARLDQLAEPTAADGLQALLADRTAYEDFDVDAAAARGMAFERLDQLAMDHLLGARG

SEQ ID NO: 239 - protein, 388 aa, Artificial Sequence
  Description of Artificial Sequence: Synthetic polypeptide
  variant of SEQ ID 220
MNYQPTPEDKFTFGLWTVGWQGRDPFGDATRPNLDPVEAVQRLAELGAYGVTFHDDDLFPFGASDTEREAHVKRFRQALDATGMTVPMASTNLFTHPVFKDGAFTANDRDVRRYALRKTIRNIDLAVELGAKVYVAWGGREGAESGAAKDVRAALDRMKEAFDLLGEYVTSQGYDIRFAIEPKPNEPRGDILLPTIGHALAFIERLERPELYGVNPEVGHEQMAGLNFPHGIAQALWAGKLFHIDLNGQSGIKYDQDLRFGAGDLRAAFWLVDLLESAGWEGPRHFDFKPPRTEDIDGVWASAAGCMRNYLILKERAAAFRADPEVQEALRAARLDQLAEPTAADGLQALLADRTAYEDFDVDAAAARGMAFERLDQLAMDHLLGARG

SEQ ID NO: 240 - protein, 388 aa, Artificial Sequence
  Description of Artificial Sequence: Synthetic polypeptide
  variant of SEQ ID 220
MNYQPTPEDKFTFGLWTVGWQGRDPFGDATRPILSPVEAVQRLAELGAYGVTFHDDDLFPFGASDTEREAHVKRFRQALDATGMTVPMASTNLFTHPVFKDGAFTANDRDVRRYALRKTIRNIDLAVELGAKVYVAWGGREGAESGAAKDVRAALDRMKEAFDLLGEYVTSQGYDIRFAIEPKPNEPRGDILLPTIGHALAFIERLERPELYGVNPEVGHEQMAGLNFPHGIAQALWAGKLFHIDLNGQSGIKYDQDLRFGAGDLRAAFWLVDLLESAGWEGPRHFDFKPPRTEDIDGVWASAAGCMRNYLILKERAAAFRADPEVQEALRAARLDQLAEPTAADGLQALLADRTAYEDFDVDAAAARGMAFERLDQLAMDHLLGARG

The invention claimed is:

1. A method for producing trehalose, comprising the steps of mixing and reacting, in any order,
   a) at least one alpha-phosphorylase capable of catalyzing the production of alpha-D-glucose 1-phosphate intermediate from a saccharide raw material, where the alpha-phosphorylase is a sucrose phosphorylase, the saccharide raw material comprises sucrose, and from at least one phosphorus source selected from the group consisting of a phosphoric acid and an inorganic salt thereof
   b) at least one trehalose phosphorylase capable of catalyzing the production of trehalose from an alpha-D-glucose 1-phosphate intermediate and a glucose substrate, wherein the glucose substrate comprises glucose and the trehalose phosphorylase is a trehalose phosphorylase variant with an amino acid sequence which differs from the amino acid sequence of a wild type trehalose phosphorylase in at least one amino acid position;
   c) at least one saccharide raw material, which is sucrose and produces an alpha-D-glucose 1-phosphate intermediate and a fructose co-product by catalytic action of the alpha-phosphorylase;
   d) at least one phosphorus source selected from the group consisting of a phosphoric acids and an inorganic salt thereof;
   e) optionally, at least one glucose isomerase,
   wherein the at least one trehalose phosphorylase comprises an amino acid sequence, wherein the amino acid sequence is at least 80% identical and/or at least 80% homologous to the amino acid sequence of SEQ ID NO: 1, wherein the amino acid sequence of the trehalose phosphorylase comprises an amino acid substitution at one or more amino acid positions,
   wherein the one or more amino acid positions is/are selected from the group consisting of the amino acid positions 712, 383, 114, 118, 192, 197, 220, 225, 304, 306, 318, 323, 339, 349, 357, 459, 476, 481, 484, 487, 488, 506, 511, 526, 530, 532, 533, 537, 550, 556, 564, 590, 667, 703 and 705 of SEQ ID NO: 1;
   wherein the at least one trehalose phosphorylase is characterized by one or more of the characteristics (A), (B), (C), and (D):
   (A) a thermal stability, wherein the thermal stability is characterized by a residual enzymatic activity of from 30% to 100% after incubation of the enzyme at 52° C. for 15 minutes; and/or
   (B) a thermal stability, wherein the thermal stability is characterized by a Tm50-value of at least 52° C. after incubation of the enzyme at 52° C. for 15 minutes; and/or
   (C) a thermal stability, wherein the thermal stability is characterized by a Tm50-value of between 52° C. and 90° C. after incubating the enzyme at 52° C. for 15 minutes; and/or
   (D) a thermal stability, wherein the thermal stability is in the form of a process stability characterized by an half-life of from 3 hours to 9 days or more.

2. The method of claim 1, further comprising the step of mixing and reacting, in any order,
   i) a glucose substrate, where the glucose substrate comprises glucose; and/or
   ii) at least one glucose isomerase
   with the at least one alpha-phosphorylase, the at least one trehalose phosphorylase, the at least one saccharide raw material, and the at least one phosphorus source.

3. The method of claim 1, wherein the method is characterized by two or more of the following conversions selected from the group consisting of:
   a) the conversion of the at least one saccharide raw material through phosphorolytic cleavage by the at least one alpha-phosphorylase and the at least one phosphorous source into an alpha-D-glucose 1-phosphate intermediate and a co-product;
   b) the conversion of the alpha-D-glucose 1-phosphate intermediate and the glucose substrate into trehalose by the at least one trehalose phosphorylase;
   c) the conversion of the fructose co-product into a glucose substrate by the at least one glucose isomerase, where the glucose substrate is glucose.

4. The method of claim 3, wherein the method is further characterized as
   a) a two-enzyme process, involving the reacting and mixing of the at least one alpha-phosphorylase, the at least one trehalose phosphorylase, the at least one saccharide raw material, the glucose substrate, and the at least one phosphorus source; and/or
   b) a three-enzyme process, involving the reacting and mixing of the at least one alpha-phosphorylase, the at least one trehalose phosphorylase, the at least one glucose isomerase, the at least one saccharide raw material, and the at least one phosphorus source; and/or
   c) a three-enzyme process, involving the reacting and mixing of the at least one alpha-phosphorylase, the at least one trehalose phosphorylase, the at least one glucose isomerase, the glucose substrate, the at least one saccharide raw material, and the at least one phosphorus source.

5. The method of claim 1, wherein the method is carried out at a temperature of at least 30° C. up to 80° C.

6. The method of claim 1, wherein the sucrose is added to the reaction in a concentration range of from 100 mM up to 2000 mM.

7. The method of claim 1, wherein the method is characterized by the use of an at least one trehalose phosphorylase which enables
   (i) a three-enzyme process comprising the steps of mixing and reacting, in any order, at least one alpha-phosphorylase, at least one glucose isomerase and at least one trehalose phosphorylase (TP), wherein the Productivity per kU of TP enzyme of trehalose from sucrose is at least 1.0 g/(L*h) per kU TP to 100 g/(L*h) per kU TP; and/or
   (ii) a two-enzyme process comprising the steps of mixing and reacting, in any order, a glucose substrate, at least one alpha-phosphorylase, and at least one trehalose phosphorylase (TP) without the addition of a glucose isomerase, wherein the Productivity per kU of TP enzyme of trehalose from saccharide raw material is at least 3 g/(L*h) per kU TP to 100 g/(L*h) per kU TP and the glucose substrate is glucose.

8. The method of claim 1, wherein the variant comprises two up to 15 of the following amino acid positions selected from the group consisting of
   a) 712A, 712G, 712I, 712M, 712P or 712V, and/or
   b) 383A, 383G, 383I, 383L, 383M, 383V, 383N, 383C, 383Q, 383S or 383T, and/or
   c) 114A, 114G, 114I, 114M, 114P or 114V, and/or
   d) 118 is 118A, 118G, 118I, 118L, 118M, 118P or 118V, and/or
   e) 225A, 225G, 225I, 225L, 225M, 225P or 225V, and/or
   f) 304G, 304I, 304L, 304M, 304P or 304V, and/or
   g) 323A, 323G, 323I, 323L, 323M, 323P, or 323V, and/or
   h) 349W or 349Y, and/or
   i) 357A, 357I, 357L, 357M, 357P or 357V, and/or
   j) 487A, 487G, 487I, 487L, 487M, 487P or 487V, and/or
   k) 550A, 550G, 550I, 550L, 550M or 550P, and/or
   l) 556N, 556C, 556Q or S556T, and/or
   m) 564D or 564E, and/or
   n) 590N, 590C, 590Q, 590S, 590T, 590A, 590G, 590I, 590L, 590M, 590P or 590V, and/or
   o) 649D or 649E,
   wherein the amino acid numbering refers to an aligning position in SEQ ID NO: 1.

9. The method of claim 1, wherein the variant comprises an amino acid substitution at two or more of the following amino acid positions selected from the group consisting of amino acid positions 383, 114, 225, 304, 323, 349, 357, 550, 556, 564, and 649, wherein the amino acid numbering refers to an aligning position in SEQ ID NO: 1.

10. The method of claim 9, wherein the trehalose phosphorylase variant comprises at least one further amino acid substitution at an amino acid position selected from the group consisting of amino acid positions 712, 118, 487 and 590, wherein the amino acid numbering refers to an aligning position in SEQ ID NO: 1.

11. The method of claim 1, wherein the variant comprises an amino acid substitution at two or more of the following amino acid positions selected from the group consisting of amino acid positions 383, 114, 225, 304, 323, 349, 357, 550, 556, and 564, wherein the amino acid numbering refers to an aligning position in SEQ ID NO: 1.

12. The method of claim 11, wherein the trehalose phosphorylase variant comprises at least one further amino acid substitution at an amino acid position selected from the group consisting of amino acid positions 712, 118, 487, 590, and 649, wherein the amino acid numbering refers to an aligning position in SEQ ID NO: 1.

13. The method of claim 1, wherein the variant comprises an amino acid substitution at two or more of the following amino acid positions selected from the group consisting of amino acid positions 383, 114, 225, 304, 323, 349, 357, 556, and 564, wherein the amino acid numbering refers to an aligning position in SEQ ID NO: 1.

14. The method of any of claim 13, wherein the trehalose phosphorylase variant comprises at least one further amino acid substitution at an amino acid positions selected from the group consisting of amino acid positions 712, 118, 487, 550, 590, and 649, wherein the amino acid numbering refers to an aligning position in SEQ ID NO: 1.

15. The method of claim 8, wherein the at least one trehalose phosphorylase variant is characterized by two or more of the characteristics selected from the group consisting of the characteristics (A), (B), (C), and (D):
   (A) a thermal stability, wherein the thermal stability is characterized by a residual enzymatic activity of from 30% to 100% after incubation of the enzyme at 52° C. for 15 minutes; and/or
   (B) a thermal stability, wherein the thermal stability is characterized by a Tm50-value of at least 52° C. after incubation of the enzyme at 52° C. for 15 minutes; and/or
   (C) a thermal stability, wherein the thermal stability is characterized by a Tm50-value of between 52° C. and 90° C. after incubating the enzyme at 52° C. for 15 minutes; and/or
   (D) a thermal stability, wherein the thermal stability is in the form of a process stability characterized by a half-life of from 3 hours to 9 days or more.

16. The method of claim 8, wherein the at least one trehalose phosphorylase is characterized in that it
   (i) enables a Productivity per kU of TP enzyme of trehalose from the saccharide raw material sucrose of at least 1.0 g/(L*h) per kU TP to 100 g/(L*h) per kU TP; and/or
   (ii) enables a three-enzyme process comprising the steps of mixing and reacting, in any order, at least one alpha-phosphorylase, at least one glucose isomerase and at least one trehalose phosphorylase (TP), wherein the Productivity per kU of TP enzyme of trehalose from sucrose is at least 1.0 g/(L*h) per kU TP to 100 g/(L*h) per kU TP; and/or
   (iii) enables a two-enzyme process comprising the steps of mixing and reacting, in any order, a glucose substrate, at least one alpha-phosphorylase, and at least one trehalose phosphorylase (TP) without the addition of a glucose isomerase, wherein the Productivity per kU of TP enzyme of trehalose from saccharide raw material is at least 3 g/(L*h) per kU TP to 100 g/(L*h) per kU TP and the glucose substrate is glucose.

17. The method of claim 1, wherein the at least one trehalose phosphorylase is characterized by two or more of the characteristics selected from the group consisting of the characteristics (A), (B), (C), and (D):
   (A) a thermal stability, wherein the thermal stability is characterized by a residual enzymatic activity of from 30% to 100% after incubation of the enzyme at 52° C. for 15 minutes; and/or
   (B) a thermal stability, wherein the thermal stability is characterized by a Tm50-value of at least 52° C. after incubation of the enzyme at 52° C. for 15 minutes; and/or (C) a thermal stability, wherein the thermal stability is characterized by a Tm50-value of between 52° C. and 90° C. after incubating the enzyme at 52° C. for 15 minutes; and/or (D) a thermal stability, wherein the thermal stability is in the form of a process stability characterized by an half-life of from 3 hours to 9 days or more.

18. The method of claim 1, wherein the at least one trehalose phosphorylase is characterized in that it
  (i) enables a Productivity per kU of TP enzyme of trehalose from the saccharide raw material sucrose of at least 1.0 g/(L*h) per kU TP to 100 g/(L*h) per kU TP; and/or
  (ii) enables a three-enzyme process comprising the steps of mixing and reacting, in any order, at least one alpha-phosphorylase, at least one glucose isomerase and at least one trehalose phosphorylase (TP), wherein the Productivity per kU of TP enzyme of trehalose from sucrose is at least 1.0 g/(L*h) per kU TP to 100 g/(L*h) per kU TP; and/or
  (iii) enables a two-enzyme process comprising the steps of mixing and reacting, in any order, a glucose substrate, at least one alpha-phosphorylase, and at least one trehalose phosphorylase (TP) without the addition of a glucose isomerase, wherein the Productivity per kU of TP enzyme of trehalose from saccharide raw material is at least 3 g/(L*h) per kU TP to 100 g/(L*h) per kU TP and the glucose substrate is glucose.

19. The method of claim 1, wherein the at least one trehalose phosphorylase comprises an amino acid sequence, wherein the amino acid sequences is selected from the group consisting of any one of
  a) SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 150, SEQ ID NO: 151, SEQ ID NO: 152, SEQ ID NO: 153, SEQ ID NO: 154, SEQ ID NO: 155, SEQ ID NO: 156, SEQ ID NO: 157, SEQ ID NO: 158, SEQ ID NO: 159, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, and SEQ ID NO: 190; and/or
  b) SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 150, SEQ ID NO: 151, SEQ ID NO: 152, SEQ ID NO: 153, SEQ ID NO: 154, SEQ ID NO: 155, SEQ ID NO: 156, SEQ ID NO: 157, SEQ ID NO: 158, SEQ ID NO: 159 and SEQ ID NO: 190; and/or
  c) SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, and SEQ ID NO: 189; and/or
  d) SEQ ID NO: 44, SEQ ID NO: 62, SEQ ID NO: 65, SEQ ID NO: 78, SEQ ID NO: 87, SEQ ID NO: 89, SEQ ID NO: 104, SEQ ID NO: 115, SEQ ID NO: 121, SEQ ID NO: 138, SEQ ID NO: 140, SEQ ID NO: 147, SEQ ID NO: 180, and SEQ ID NO: 188.

20. The method of claim 1, wherein the at least one trehalose phosphorylase comprises an amino acid sequence selected from the group consisting of any one of SEQ ID NO: 2, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, and SEQ ID NO: 170.

21. The method of claim 1, wherein the at least one alpha-phosphorylase is a sucrose phosphorylase, wherein the sucrose phosphorylase has at least 75% sequence identity and/or sequence homology to an amino acid sequence selected from the group consisting of SEQ ID NO: 202 and SEQ ID NO: 205.

22. The method of claim 1, wherein the at least one glucose isomerase is mixed and reacted, and the at least one glucose isomerase is a glucose isomerase with at least 95% sequence identity and/or sequence homology to the amino acid sequence of SEQ ID NO: 220.

23. The method of claim 1, wherein
i) the at least one alpha-phosphorylase is in form of a sucrose phosphorylase comprising or consisting of an amino acid sequence selected from the group of sequences consisting of SEQ ID NO: 202, SEQ ID NO: 203, SEQ ID NO: 204, SEQ ID NO: 205, SEQ ID NO: 206, SEQ ID NO: 207, SEQ ID NO: 208, SEQ ID NO: 209, SEQ ID NO: 210, SEQ ID NO: 211, SEQ ID NO: 212, SEQ ID NO: 213, SEQ ID NO: 214, SEQ ID NO: 215, SEQ ID NO: 216, SEQ ID NO: 217, SEQ ID NO: 218 and SEQ ID NO: 219; and/or
ii) the at least one trehalose phosphorylase is in form of a trehalose phosphorylase comprising or consisting of an amino acid sequence selected from the group of sequences consisting of SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 150, SEQ ID NO: 151, SEQ ID NO: 152, SEQ ID NO: 153, SEQ ID NO: 154, SEQ ID NO: 155, SEQ ID NO: 156, SEQ ID NO: 157, SEQ ID NO: 158, SEQ ID NO: 159, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, and/or
iii) the at least one glucose isomerase is mixed and reacted in the form of a glucose isomerase comprising an amino acid sequence selected from the group of sequences consisting of SEQ ID NO: 220 to SEQ ID NO: 240.

* * * * *